United States Patent
Li et al.

(10) Patent No.: US 10,301,604 B2
(45) Date of Patent: May 28, 2019

(54) ENGINEERED GLUCOSYLTRANSFERASES

(71) Applicant: E I DU PONT DE NEMOURS AND COMPANY, Wilmington, DE (US)

(72) Inventors: Yougen Li, Pennington, NJ (US); Mark S. Payne, Wilmington, DE (US); Jared B. Parker, Elkton, MD (US); Slavko Kralj, Copenhagen K (DK); Veli Alkan, Palo Alto, CA (US); Richard R. Bott, Palo Alto, CA (US); Robert Dicosimo, Chadds Ford, PA (US); Qiong Cheng, Wilmington, DE (US); Ellen D. Semke, Newark, DE (US); Susan Marie Hennessey, Avondale, PA (US)

(73) Assignee: E I DU PONT DE NEMOURS AND COMPANY, Wilmington, DE (US)

( * ) Notice: Subject to any disclaimer, the term of this patent is extended or adjusted under 35 U.S.C. 154(b) by 0 days.

(21) Appl. No.: 15/702,893

(22) Filed: Sep. 13, 2017

(65) Prior Publication Data

US 2018/0072998 A1    Mar. 15, 2018

Related U.S. Application Data

(60) Provisional application No. 62/394,354, filed on Sep. 13, 2017.

(51) Int. Cl.
| | | |
|---|---|---|
| *C12N 9/10* | (2006.01) | |
| *C12P 19/04* | (2006.01) | |
| *C12P 19/18* | (2006.01) | |
| *C08B 37/00* | (2006.01) | |

(52) U.S. Cl.
CPC ........ *C12N 9/1051* (2013.01); *C08B 37/0009* (2013.01); *C12P 19/04* (2013.01); *C12P 19/18* (2013.01)

(58) Field of Classification Search
None
See application file for complete search history.

(56) References Cited

U.S. PATENT DOCUMENTS

| | | | |
|---|---|---|---|
| 5,952,205 A | 9/1999 | Catani et al. | |
| 6,207,149 B1 | 3/2001 | Fuglsang et al. | |
| 6,242,225 B1 | 6/2001 | Catani et al. | |
| 6,660,502 B2 | 12/2003 | Catani et al. | |
| 7,000,000 B1 | 2/2006 | O'Brien | |
| 7,524,645 B2 | 4/2009 | Monsan et al. | |
| 8,269,064 B2 | 9/2012 | Kok-Jacon et al. | |
| 8,871,474 B2 | 10/2014 | Payne et al. | |
| 9,228,177 B2 | 1/2016 | Payne et al. | |
| 9,260,701 B2 | 2/2016 | Payne et al. | |
| 9,260,702 B2 | 2/2016 | Payne et al. | |
| 9,284,539 B2 | 3/2016 | Payne et al. | |
| 9,284,540 B2 | 3/2016 | Payne et al. | |
| 9,296,996 B2 | 3/2016 | Payne et al. | |
| 9,296,997 B2 | 3/2016 | Payne et al. |
| 9,399,765 B2 | 7/2016 | Monsan et al. |
| 2002/0155568 A1 | 10/2002 | Van Geel-Schutten et al. |
| 2006/0057704 A1 | 3/2006 | Schlothauer et al. |
| 2006/0127328 A1 | 6/2006 | Monsan et al. |
| 2011/0144317 A1 | 6/2011 | Mulard et al. |
| 2013/0036918 A1 | 2/2013 | Sakane |
| 2013/0036968 A1 | 2/2013 | Suzuki et al. |
| 2013/0096502 A1 | 4/2013 | Kawamoto et al. |
| 2013/0096511 A1 | 4/2013 | MacArthur |
| 2013/0244287 A1 | 9/2013 | O'Brien et al. |
| 2013/0244288 A1 | 9/2013 | O'Brien et al. |
| 2014/0087431 A1 | 3/2014 | Payne et al. |
| 2015/0218532 A1 | 8/2015 | Cote et al. |
| 2015/0232785 A1 | 8/2015 | Paullin et al. |
| 2015/0232819 A1 | 8/2015 | Paullin et al. |
| 2017/0002335 A1 | 1/2017 | Payne et al. |
| 2017/0002336 A1 | 1/2017 | Payne et al. |
| 2017/0218093 A1 | 8/2017 | Cheng et al. |

FOREIGN PATENT DOCUMENTS

| | | |
|---|---|---|
| JP | 2000175694 A | 6/2000 |
| WO | 2015183714 A1 | 12/2015 |
| WO | 2015183721 A1 | 12/2015 |
| WO | 2015183722 A1 | 12/2015 |
| WO | 2015183724 A1 | 12/2015 |
| WO | 2015183726 A1 | 12/2015 |
| WO | 2015183729 A1 | 12/2015 |

OTHER PUBLICATIONS

Ngo et al. In the Protein Folding Problem and Tertiary Structure Prediction, 1994, Merz et al. (ed.), Birkhauser, Boston, MA, pp. 433 and 492-495.*

Simpson et al., Four Glucosyltransferases, GTFJ, GTFK, GTFL and GTFM, From *Streptococcus salivarius* ATCC 25975, Microbiology, vol. 141 (1995), pp. 1451-1460.

Leemhuis et al., Glucansucrases: Three-Dimensional Structures, Reactions, Mechanism, α-Glucan Analysis and Their Implications in Biotechnology and Food Applications, Journal of Biotechnology, vol. 163 (2013), pp. 250-272.

Monchois et al., Glucansucrases: Mechanism of Action and Structure-Function Relationships, FEMS Microbiology Reviews, vol. 23 (1999), pp. 131-151.

Monchois et al., Isolation of an Active Catalytic Core of *Streptococcus downei* MFE28 GTF-I Glucosyltransferase, Journal of Bacteriology, vol. 181, No. 7 (1999), pp. 2290-2292.

Rogers, Chapter 5: The Molecular Biology of Cariogenic Bacteria, From Molecular Biology, Horizon Scientific Press, Roy RB Russell (2008), pp. 120-122.

(Continued)

*Primary Examiner* — Richard G Hutson

(57) ABSTRACT

Disclosed herein are glucosyltransferases with modified amino acid sequences. Such engineered enzymes exhibit improved alpha-glucan product yields and/or lower leucrose yields, for example. Further disclosed are reactions and methods in which engineered glucosyltransferases are used to produce alpha-glucan.

20 Claims, No Drawings

Specification includes a Sequence Listing.

(56) References Cited

OTHER PUBLICATIONS

Konishi et al., Structure and Enzymatic Properties of Genetically Truncated Forms of the Water-Insoluble Glucan-Synthesizing Glucosyltransferase From *Streptococcus sobrinus*, J. Biochem., vol. 126 (1999), pp. 287-295.
Tsumuraya et al., Structure of the Water-Insoluble α-D-Glucan of *Streptococcus salivarius* HHT, Carbohydrate Research, vol. 74 (1979), pp. 217-225.
Weaver et al., Weighted Intrinsic Viscosity Relationships for Polysaccharide Mixtures in Dilute Aqueous Solutions, Journal of Applied Polymer Science, vol. 35 (1988), pp. 1631-1637.
Yakushiji et al., Inter-Serotype Comparison of Polysaccharides Produced by Extracellular Enzymes From *Streptococcus mutans*, Carbohydrate Research, vol. 127 (1984), pp. 253-266.
Yoshimi et al., Functional Analysis of the α-1,3-Glucan Synthase Genes AGSA and AGSB in Aspergillus Nidulans: AGSB Is the Major α-1,3-Glucan Synthase in This Fungus, PLOS One, vol. 8, Issue 1 (2013), pp. 1-16.
Cote and Skory, Effects of mutations at threonine-654 on the insoluble glucan synthesized by Leuconostoc rnesenteroides NRRL B-1118 glucansucrase, Appl. Microbiol, Biotechnol., vol. 98, (2014), pp. 6651-6658.
International Search Report, PCT International Appl. PCT/US2017/051279, dated Dec. 15, 2017.
Castillo et al., Synthesis of Levan in Water-Miscible Organic Solvents, Journal of Biotechnology, vol. 114 (2004), pp. 209-217.
Aman et al., Influence of Temperature, Metal Ions and Organic Solvents on Extracellular Glucansucrase Activity of Leuconostoc Mesenteroidses AA1, J. Chem. Soc., vol. 30, No. 6 (2008), pp. 849-853.
Girard et al., Activity and Stability of Dextransucrase From Leuconostoc Mesenteroides NRRL B-512F in the Presence of Organic Solvents, Enzyme and Microbial Technology, vol. 24 (1999), pp. 425-432.
Chambert et al., Study of the Effect of Organic Solvents on the Synthesis of Levan and the Hydrolysis of Sucrose by Bacillus Subtilis Levansucrase, Carbohydrate Research, vol. 191 (1989), pp. 117-123.
Kralj et al., Rational Transformation of Lactobacillus Reuteri 121 Reuteransucrase Into a Dextrasucrase, Biochemistry, vol. 44 (2005), pp. 9206-9216.
Ozimek et al., Single Amino Acid Residue Changes in Subsite-1 of Inulosucrase From Lactobacillus Reuteri 121 Strongly Influence the Size of Products Synthesized, FEBS Journal, vol. 273 (2006), pp. 4104-4113.
Kralj et al., Biochemistry and Molecular Characterization of Lactobacillus Reuteri 121 Reuteransucrase, Microbiology, vol. 150 (2004), pp. 2099-2112.
Van Der Veen et al., Hydrophobic Amino Acid Residues in the Acceptor Binding Site are Main Determinants for Reaction Mechanism and Specificity of Cyclodextrin-Glycosyltransferase, The Journal of Biological Chemistry, vol. 276, No. 48 (2001), pp. 44557-44562.
Kralj et al., Role of Asparagine 1134 in Glucosidic Bond and Transglycosylation Specificity of Reuteransucrase From Lactobacillus Reuteri 121, FEBS Journal, vol. 273 (2006), pp. 3735-3742.
Kang et al., Bioengineering of Leuconostoc Mesenteroides Glucansucrases That Gives Selected Bond Formation for Glucan Synthesis and/or Acceptor-Product Synthesis, Journal of Agricultural and Food Chemistry, vol. 59 (2011), pp. 4148-4155.
Irague et al., Combinatorial Engineering of Dextransucrase Specificity, PLOS One, vol. 8, No. 10 (2013), pp. 1-14.
Vujicic-Zagar et al., Crystal Structure of 117 KDA Glucansucrase Fragment Provides Insight Into Evolution and Product Specificity of GH70 Enzymes, PNAS, vol. 107, No. 50 (2010), pp. 21406-21411.
Van Leeuwen et al., Structural Characterization of Bioengineered α-D-Glucans Produced by Mutant Glucansucrase GTF180 Enzymes of Lactobacillus Reuteri Strain 180, Biomacromolecules, vol. 10 (2009), pp. 580-588.
Van Leeuwen et al., Structural of Bioengineered α-D-Glucan Produced by a Triple Mutant of the Glucansucrase GTF180 Enzyme from Lactobacillus Reuteri Strain 180: Generation of (α1->4) Linkages in a Native (1->3)(1->6)-α-D-Glucan, Biomacromolecules, vol. 9 (2008), pp. 2251-2258.
Meng et al., Residue LEU 940 Has a Crucial Role in the Linkage and Reaction Specificity of the Glucansucrase GTF180 of the Probiotic Bacterium Lactobacillus Reuteri 180, Journal of Biological Chemistry, vol. 289, No. 47 (2014), pp. 32773-32782.
Cote et al., Some Structural Features of an Insoluble-D-Glucan From a Mutant Strain of Leuconostoc Mesenteroides NRRL B-1355, Journal of Industrial Microbiology & Biotechnology, vol. 23 (1999), pp. 656-660.
Hellmuth et al., Engineering the Glucansucrase Gtfr Enzyme Reaction and Glycosidic Bond Specificity: Toward Tailor-Made Polymer and Oligosaccharide Products, Biochemistry, vol. 47 (2008), pp. 6678-6684.

\* cited by examiner

ENGINEERED GLUCOSYLTRANSFERASES

This application claims the benefit of U.S. Provisional Application No. 62/394,354 (filed Sep. 14, 2016), which is incorporated herein by reference in its entirety.

FIELD

The present disclosure is in the field of enzyme catalysis. For example, the disclosure pertains to glucosyltransferase enzymes with modified amino acid sequences. Such modified enzymes have improved product yield properties.

REFERENCE TO SEQUENCE LISTING SUBMITTED ELECTRONICALLY

The official copy of the sequence listing is submitted electronically via EFS-Web as an ASCII formatted sequence listing with a file named CL6395USNP_SequenceListing_ST25_ExtraLinesRemoved.txt created on Sep. 11, 2017, and having a size of 612 kilobytes and is filed concurrently with the specification. The sequence listing contained in this ASCII-formatted document is part of the specification and is herein incorporated by reference in its entirety.

BACKGROUND

Driven by a desire to use polysaccharides in various applications, researchers have explored for polysaccharides that are biodegradable and that can be made economically from renewably sourced feedstocks. One such polysaccharide is alpha-1,3-glucan, an insoluble glucan polymer characterized by having alpha-1,3-glycosidic linkages. This polymer has been prepared, for example, using a glucosyltransferase enzyme isolated from *Streptococcus salivarius* (Simpson et al., *Microbiology* 141:1451-1460, 1995). Also for example, U.S. Pat. No. 7,000,000 disclosed the preparation of a spun fiber from enzymatically produced alpha-1,3-glucan.

Various other glucan materials have also been studied for developing new or enhanced applications. For example, U.S. Patent Appl. Publ. No. 2015/0232819 discloses enzymatic synthesis of several insoluble glucans having mixed alpha-1,3 and -1,6 linkages. Large soluble glucans, such as those having a high percentage of alpha-1,6 linkages, have also been enzymatically synthesized (e.g., U.S. Patent Appl. Publ. No. 2016/0122445). Various enzymatic synthesis routes are disclosed in International Patent Appl. Publ. Nos. WO2015/183721, WO2015/183724, WO2015/183729, WO2015/183722, WO2015/183726 and WO2015/183714 for producing small soluble glucan materials suitable for use in dietary and other applications.

While these and other advances have been made in producing glucan polymers using glucosyltransferase enzymes, less attention appears to have been drawn to improving the glucan yields of such enzymes. Addressing this technological gap, disclosed herein are glucosyltransferases engineered to have modified amino acid sequences endowing these enzymes with enhanced glucan production properties.

SUMMARY

In one embodiment, the present disclosure concerns a non-native glucosyltransferase comprising at least one amino acid substitution at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62, wherein the non-native glucosyltransferase synthesizes alpha-glucan comprising 1,3-linkages and/or 1,6-linkages, and wherein the non-native glucosyltransferase has:

(i) an alpha-glucan yield that is higher than the alpha-glucan yield of a second glucosyltransferase that only differs from the non-native glucosyltransferase at the substitution position(s), and/or (ii) a leucrose yield that is lower than the leucrose yield of the second glucosyltransferase.

In another embodiment, the present disclosure concerns a polynucleotide comprising a nucleotide sequence encoding a non-native glucosyltransferase as presently disclosed, optionally wherein one or more regulatory sequences are operably linked to the nucleotide sequence, and preferably wherein the one or more regulatory sequences include a promoter sequence.

In another embodiment, the present disclosure concerns a reaction composition comprising water, sucrose, and a non-native glucosyltransferase as presently disclosed.

In another embodiment, the present disclosure concerns a method of producing alpha-glucan comprising: (a) contacting at least water, sucrose, and a non-native glucosyltransferase enzyme as presently disclosed, whereby alpha-glucan is produced; and b) optionally, isolating the alpha-glucan produced in step (a).

In another embodiment, the present disclosure concerns a method of preparing a polynucleotide sequence encoding a non-native glucosyltransferase, the method comprising: (a) identifying a polynucleotide sequence encoding a parent glucosyltransferase that (i) comprises an amino acid sequence that is at least about 30% identical to SEQ ID NO:4 or positions 55-960 of SEQ ID NO:4, and (ii) synthesizes alpha-glucan comprising 1,3-linkages and/or 1,6-linkages; and (b) modifying the polynucleotide sequence identified in step (a) to substitute at least one amino acid of the parent glucosyltransferase at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62, thereby providing a polynucleotide sequence encoding a non-native glucosyltransferase that has:

(i) an alpha-glucan yield that is higher than the alpha-glucan yield of the parent glucosyltransferase, and/or (ii) a leucrose yield that is lower than the leucrose yield of the parent glucosyltransferase.

BRIEF DESCRIPTION OF THE SEQUENCES

TABLE 1

Summary of Nucleic Acid and Protein SEQ ID Numbers

| Description | Nucleic acid SEQ ID NO. | Protein SEQ ID NO. |
|---|---|---|
| GTF 0874, *Streptococcus sobrinus*. The first 156 amino acids of the protein are deleted compared to GENBANK Identification No. 450874; a start methionine is included. | 1[a] | 2 (1435 aa) |

TABLE 1-continued

Summary of Nucleic Acid and Protein SEQ ID Numbers

| Description | Nucleic acid SEQ ID NO. | Protein SEQ ID NO. |
|---|---|---|
| GTF 6855, *Streptococcus salivarius* SK126. The first 178 amino acids of the protein are deleted compared to GENBANK Identification No. 228476855 (Acc. No. ZP_04061500.1); a start methionine is included. | 3[a] | 4 (1341 aa) |
| GTF 2379, *Streptococcus salivarius*. The first 203 amino acids of the protein are deleted compared to GENBANK Identification No. 662379; a start methionine is included. | 5[a] | 6 (1247 aa) |
| GTF 7527 or GTFJ, *Streptococcus salivarius*. The first 42 amino acids of the protein are deleted compared to GENBANK Identification No. 47527; a start methionine is included. | 7[a] | 8 (1477 aa) |
| GTF 1724, *Streptococcus downei*. The first 162 amino acids of the protein are deleted compared to GENBANK Identification No. 121724; a start methionine is included. | 9[a] | 10 (1436 aa) |
| GTF 0544, *Streptococcus mutans*. The first 164 amino acids of the protein are deleted compared to GENBANK Identification No. 290580544; a start methionine is included. | 11[a] | 12 (1313 aa) |
| GTF 5926, *Streptococcus dentirousetti*. The first 144 amino acids of the protein are deleted compared to GENBANK Identification No. 167735926; a start methionine is included. | 13[a] | 14 (1323 aa) |
| GTF 4297, *Streptococcus oralis*. The first 228 amino acids of the protein are deleted compared to GENBANK Identification No. 7684297; a start methionine is included. | 15[a] | 16 (1348 aa) |
| GTF 5618, *Streptococcus sanguinis*. The first 223 amino acids of the protein are deleted compared to GENBANK Identification No. 328945618; a start methionine is included. | 17[a] | 18 (1348 aa) |
| GTF 2765, unknown *Streptococcus* sp. C150. The first 193 amino acids of the protein are deleted compared to GENBANK Identification No. 322372765; a start methionine is included. | 19[a] | 20 (1340 aa) |
| GTF 4700, *Leuconostoc mesenteroides*. The first 36 amino acids of the protein are deleted compared to GENBANK Identification No. 21654700; a start methionine is included. | 21[a] | 22 (1492 aa) |
| GTF 1366, *Streptococcus criceti*. The first 139 amino acids of the protein are deleted compared to GENBANK Identification No. 146741366; a start methionine is included. | 23[a] | 24 (1323 aa) |
| GTF 0427, *Streptococcus sobrinus*. The first 156 amino acids of the protein are deleted compared to GENBANK Identification No. 940427; a start methionine is included. | 25[a] | 26 (1435 aa) |
| GTF 2919, *Streptococcus salivarius* PS4. The first 92 amino acids of the protein are deleted compared to GENBANK Identification No. 383282919; a start methionine is included. | 27[a] | 28 (1340 aa) |
| GTF 2678, *Streptococcus salivarius* K12. The first 188 amino acids of the protein are deleted compared to GENBANK Identification No. 400182678; a start methionine is included. | 29[a] | 30 (1341 aa) |
| GTF 2381, *Streptococcus salivarius*. The first 273 amino acids of the protein are deleted compared to GENBANK Identification No. 662381; a start methionine is included. | 31[a] | 32 (1305 aa) |
| GTF 3929, *Streptococcus salivarius* JIM8777. The first 178 amino acids of the protein are deleted compared to GENBANK Identification No. 387783929; a start methionine is included. | 33[a] | 34 (1341 aa) |
| GTF 6907, *Streptococcus salivarius* SK126. The first 161 amino acids of the protein are deleted compared to GENBANK Identification No. 228476907; a start methionine is included. | 35[a] | 36 (1331 aa) |
| GTF 6661, *Streptococcus salivarius* SK126. The first 265 amino acids of the protein are deleted compared to GENBANK Identification No. 228476661; a start methionine is included. | 37[a] | 38 (1305 aa) |
| GTF 0339, *Streptococcus gallolyticus* ATCC 43143. The first 213 amino acids of the protein are deleted compared to GENBANK Identification No. 334280339; a start methionine is included. | 39[a] | 40 (1310 aa) |
| GTF 0088, *Streptococcus mutans*. The first 189 amino acids of the protein are deleted compared to GENBANK Identification No. 3130088; a start methionine is included. | 41[a] | 42 (1267 aa) |
| GTF 9358, *Streptococcus mutans* UA159. The first 176 amino acids of the protein are deleted compared to GENBANK Identification No. 24379358; a start methionine is included. | 43[a] | 44 (1287 aa) |
| GTF 8242, *Streptococcus gallolyticus* ATCC BAA-2069. The first 191 amino acids of the protein are deleted compared to GENBANK Identification No. 325978242; a start methionine is included. | 45[a] | 46 (1355 aa) |

TABLE 1-continued

Summary of Nucleic Acid and Protein SEQ ID Numbers

| Description | Nucleic acid SEQ ID NO. | Protein SEQ ID NO. |
|---|---|---|
| GTF 3442, *Streptococcus sanguinis* SK405. The first 228 amino acids of the protein are deleted compared to GENBANK Identification No. 324993442; a start methionine is included. | 47[a] | 48 (1348 aa) |
| GTF 7528, *Streptococcus salivarius*. The first 173 amino acids of the protein are deleted compared to GENBANK Identification No. 47528; a start methionine is included. | 49[a] | 50 (1427 aa) |
| GTF 3279, *Streptococcus* sp. C150. The first 178 amino acids of the protein are deleted compared to GENBANK Identification No. 322373279; a start methionine is included. | 51[a] | 52 (1393 aa) |
| GTF 6491, *Leuconostoc citreum* KM20. The first 244 amino acids of the protein are deleted compared to GENBANK Identification No. 170016491; a start methionine is included. | 53[a] | 54 (1262 aa) |
| GTF 6889, *Streptococcus salivarius* SK126. The first 173 amino acids of the protein are deleted compared to GENBANK Identification No. 228476889; a start methionine is included. | 55[a] | 56 (1427 aa) |
| GTF 4154, *Lactobacillus reuteri*. The first 38 amino acids of the protein are deleted compared to GENBANK Identification No. 51574154. | 57[a] | 58 (1735 aa) |
| GTF 3298, *Streptococcus* sp. C150. The first 209 amino acids of the protein are deleted compared to GENBANK Identification No. 322373298; a start methionine is included. | | 59 (1242 aa) |
| Wild type GTFJ, *Streptococcus salivarius*. GENBANK Identification No. 47527. | | 60 (1518 aa) |
| Wild type GTF corresponding to GTF 2678, *Streptococcus salivarius* K12. | | 61 (1528 aa) |
| Wild type GTF corresponding to GTF 6855, *Streptococcus salivarius* SK126. | | 62 (1518 aa) |
| Wild type GTF corresponding to GTF 2919, *Streptococcus salivarius* PS4. | | 63 (1431 aa) |
| Wild type GTF corresponding to GTF 2765, unknown *Streptococcus* sp. C150. | | 64 (1532 aa) |
| Shorter version of GTF 7527, *Streptococcus salivarius*, (also referred to as "7527-NT" herein. The first 178 amino acids of the protein are deleted compared to GEN BANK Identification No. 47527; a start methionine is included. | | 65 (1341 aa) |
| Catalytic domain (approx.) of GTF 6855 (i.e., positions 55-960 of SEQ ID NO: 4), but having a Glu at position 279, which corresponds to position 510 (Ala) of SEQ ID NO: 62. | | 66 (906 aa) |
| Terminator sequence added to pHY300PLK to derive the pHYT vector. | 67 | |
| Wild type GTF 5604, *Streptococcus criceti*. GENBANK Identification No. 357235604 or 4691428. | | 68 (1338 aa) |
| Wild type GTF 8845, *Streptococcus sobrinus*. GENBANK Identification No. 22138845. | | 69 (1554 aa) |
| N-terminal truncated form of GTF 8845, including a heterologous signal sequence. | | 70 (1414 aa) |
| Catalytic domain (approx.) of GTF 6855 (i.e., positions 55-960 of SEQ ID NO: 4), but having an Asp at position 279, which corresponds to position 510 (Ala) of SEQ ID NO: 62. | | 71 (906 aa) |

[a]This DNA coding sequence is codon-optimized for expression in *E. coli*, and is merely disclosed as an example of a suitable coding sequence.

DETAILED DESCRIPTION

The disclosures of all cited patent and non-patent literature are incorporated herein by reference in their entirety.

Unless otherwise disclosed, the terms "a" and "an" as used herein are intended to encompass one or more (i.e., at least one) of a referenced feature.

Where present, all ranges are inclusive and combinable, except as otherwise noted. For example, when a range of "1 to 5" is recited, the recited range should be construed as including ranges "1 to 4", "1 to 3", "1-2", "1-2 & 4-5", "1-3 & 5", and the like.

The terms "alpha-glucan", "alpha-glucan polymer" and the like are used interchangeably herein. An alpha-glucan is a polymer comprising glucose monomeric units linked together by alpha-glycosidic linkages. In typical embodiments, an alpha-glucan herein comprises at least about 80%, 81%, 82%, 83%, 84%, 85%, 86%, 87%, 88%, 89%, 90%, 91%, 92%, 93%, 94%, 95%, 96%, 97%, 98%, 99%, or 100% alpha-glycosidic linkages. Examples of alpha-glucan polymers herein include alpha-1,3-glucan and dextran.

The terms "poly alpha-1,3-glucan", "alpha-1,3-glucan", "alpha-1,3-glucan polymer" and the like are used interchangeably herein. Alpha-1,3-glucan is a polymer comprising glucose monomeric units linked together by glycosidic linkages, wherein at least about 50% of the glycosidic linkages are alpha-1,3. Alpha-1,3-glucan in certain embodiments comprises at least 90% or 95% alpha-1,3 glycosidic linkages. Most or all of the other linkages in alpha-1,3-glucan herein typically are alpha-1,6, though some linkages may also be alpha-1,2 and/or alpha-1,4.

The term "dextran" herein refers to a water-soluble alpha-glucan comprising at least 50% (up to 100%) alpha-1,6 glycosidic linkages (with up to 49% alpha-1,3 glycosidic linkages, some of which may occur at branching points). Glucosyltransferases capable of synthesizing dextran from sucrose may optionally be described as "dextransucrases" (EC 2.4.1.5).

The terms "glycosidic linkage", "glycosidic bond", "linkage" and the like are used interchangeably herein and refer to the covalent bond that joins a carbohydrate (sugar) molecule to another group such as another carbohydrate. The term "alpha-1,3-glycosidic linkage" as used herein refers to the type of covalent bond that joins alpha-D-glucose molecules to each other through carbons 1 and 3 on adjacent alpha-D-glucose rings. The term "alpha-1,6-glycosidic linkage" as used herein refers to the covalent bond that joins alpha-D-glucose molecules to each other through carbons 1 and 6 on adjacent alpha-D-glucose rings. The glycosidic linkages of a glucan polymer herein can also be referred to as "glucosidic linkages". Herein, "alpha-D-glucose" will be referred to as "glucose".

The glycosidic linkage profile of an alpha-glucan herein can be determined using any method known in the art. For example, a linkage profile can be determined using methods using nuclear magnetic resonance (NMR) spectroscopy (e.g., $^{13}$C NMR or $^1$H NMR). These and other methods that can be used are disclosed in, for example, *Food Carbohydrates: Chemistry, Physical Properties, and Applications* (S. W. Cui, Ed., Chapter 3, S. W. Cui, Structural Analysis of Polysaccharides, Taylor & Francis Group LLC, Boca Raton, Fla., 2005), which is incorporated herein by reference.

The "molecular weight" of large alpha-glucan polymers herein can be represented as weight-average molecular weight (Mw) or number-average molecular weight (Mn), the units of which are in Daltons or grams/mole. Alternatively, the molecular weight of large alpha-glucan polymers can be represented as $DP_w$ (weight average degree of polymerization) or $DP_n$ (number average degree of polymerization). The molecular weight of smaller alpha-glucan polymers such as oligosaccharides typically can be provided as "DP" (degree of polymerization), which simply refers to the number of glucoses comprised within the alpha-glucan. Various means are known in the art for calculating these various molecular weight measurements such as with high-pressure liquid chromatography (HPLC), size exclusion chromatography (SEC), or gel permeation chromatography (GPC).

The term "sucrose" herein refers to a non-reducing disaccharide composed of an alpha-D-glucose molecule and a beta-D-fructose molecule linked by an alpha-1,2-glycosidic bond. Sucrose is known commonly as table sugar.

The terms "leucrose" and "D-glucopyranosyl-alpha(1-5)-D-fructopyranose" are used interchangeably herein and refer to a disaccharide containing an alpha-1,5 glucosyl-fructose linkage.

The terms "glucosyltransferase", "glucosyltransferase enzyme", "GTF", "glucansucrase" and the like are used interchangeably herein. The activity of a glucosyltransferase herein catalyzes the reaction of the substrate sucrose to make the products alpha-glucan and fructose. Other products (by-products) of a GTF reaction can include glucose, various soluble gluco-oligosaccharides, and leucrose. Wild type forms of glucosyltransferase enzymes generally contain (in the N-terminal to C-terminal direction) a signal peptide (which is typically removed by cleavage processes), a variable domain, a catalytic domain, and a glucan-binding domain. A glucosyltransferase herein is classified under the glycoside hydrolase family 70 (GH70) according to the CAZy (Carbohydrate-Active EnZymes) database (Cantarel et al., *Nucleic Acids Res.* 37:D233-238, 2009).

The term "glucosyltransferase catalytic domain" herein refers to the domain of a glucosyltransferase enzyme that provides alpha-glucan-synthesizing activity to a glucosyltransferase enzyme. A glucosyltransferase catalytic domain preferably does not require the presence of any other domains to have this activity.

The terms "enzymatic reaction", "glucosyltransferase reaction", "glucan synthesis reaction", "reaction composition", "reaction formulation" and the like are used interchangeably herein and generally refer to a reaction that initially comprises water, sucrose, at least one active glucosyltransferase enzyme, and optionally other components. Components that can be further present in a glucosyltransferase reaction typically after it has commenced include fructose, glucose, leucrose, soluble gluco-oligosaccharides (e.g., DP2-DP7) (such may be considered as products or by-products, depending on the glucosyltransferase used), and/or insoluble alpha-glucan product(s) of DP8 or higher (e.g., DP100 and higher). It would be understood that certain glucan products, such as alpha-1,3-glucan with a degree of polymerization (DP) of at least 8 or 9, are water-insoluble and thus not dissolved in a glucan synthesis reaction, but rather may be present out of solution (e.g., by virtue of having precipitated from the reaction). It is in a glucan synthesis reaction where the step of contacting water, sucrose and a glucosyltransferase enzyme is performed. The term "under suitable reaction conditions" as used herein refers to reaction conditions that support conversion of sucrose to alpha-glucan product(s) via glucosyltransferase enzyme activity.

The "yield" of an alpha-glucan product in a glucosyltransferase reaction in some aspects herein represents the molar yield based on the converted sucrose. The molar yield of an alpha-glucan product can be calculated based on the moles of the alpha-glucan product divided by the moles of the sucrose converted. Moles of converted sucrose can be calculated as follows: (mass of initial sucrose−mass of final sucrose)/molecular weight of sucrose [342 g/mol]. This molar yield calculation can be considered as a measure of selectivity of the reaction toward the alpha-glucan. In some aspects, the "yield" of an alpha-glucan product in a glucosyltransferase reaction can be based on the glucosyl component of the reaction. Such a yield (yield based on glucosyl) can be measured using the following formula:

$$\text{Alpha-Glucan Yield} = ((IS/2 - (FS/2 + LE/2 + GL + SO))/(IS/2 - FS/2)) \times 100\%.$$

The fructose balance of a glucosyltransferase reaction can be measured to ensure that HPLC data, if applicable, are not out of range (90-110% is considered acceptable). Fructose balance can be measured using the following formula:

$$\text{Fructose Balance} = ((180/342 \times (FS + LE) + FR)/(180/342 \times IS)) \times 100\%.$$

In the above two formulae, IS is [Initial Sucrose], FS is [Final Sucrose], LE is [Leucrose], GL is [Glucose], SO is [Soluble Oligomers] (gluco-oligosaccharides), and FR is [Fructose] (all concentrations in units of grams/L and as measured by HPLC, for example).

The terms "percent by volume", "volume percent", "vol %", "v/v %" and the like are used interchangeably herein. The percent by volume of a solute in a solution can be determined using the formula: [(volume of solute)/(volume of solution)]×100%.

The terms "percent by weight", "weight percentage (wt %)", "weight-weight percentage (% w/w)" and the like are used interchangeably herein. Percent by weight refers to the percentage of a material on a mass basis as it is comprised in a composition, mixture, or solution.

The terms "aqueous conditions", "aqueous reaction conditions", "aqueous setting", "aqueous system" and the like are used interchangeably herein. Aqueous conditions herein refer to a solution or mixture in which the solvent is at least about 60 wt % water, for example. A glucosyltransferase reaction herein is performed under aqueous conditions.

The terms "soluble", "aqueous-soluble", "water-soluble" and the like as used herein characterize a glucan that has the capability of dissolving in water and/or an aqueous solution herein. Examples of soluble glucans herein are certain oligosaccharides, such as alpha-1,3-glucan with a DP less than 8, and certain oligosaccharides disclosed in International Patent Appl. Publ. Nos. WO2015/183721, WO2015/183724, WO2015/183729, WO2015/183722, WO2015/183726 and WO2015/183714, which are incorporated herein by reference. In contrast, a glucan that is "insoluble", "aqueous-insoluble", "water-insoluble" (and like terms) does not dissolve (or does not appreciably dissolve) in water and/or an aqueous solution herein. Optionally, the conditions for determining solubility include a water/solution temperature range of about 1 to 85° C. (e.g., 20-25° C.) and/or a neutral pH range of about 6-8.

The terms "polynucleotide", "polynucleotide sequence", "nucleic acid molecule" and the like are used interchangeably herein. These terms encompass nucleotide sequences and the like. A polynucleotide may be a polymer of DNA or RNA that is single- or double-stranded, that optionally contains synthetic, non-natural or altered nucleotide bases. A polynucleotide may be comprised of one or more segments of cDNA, genomic DNA, synthetic DNA, or mixtures thereof.

The term "gene" as used herein refers to a DNA polynucleotide sequence that expresses an RNA (RNA is transcribed from the DNA polynucleotide sequence) from a coding region, which RNA can be a messenger RNA (encoding a protein) or a non-protein-coding RNA. A gene may refer to the coding region alone, or may include regulatory sequences upstream and/or downstream to the coding region (e.g., promoters, 5'-untranslated regions, 3'-transcription terminator regions). A coding region encoding a protein can alternatively be referred to herein as an "open reading frame" (ORF). A gene that is "native" or "endogenous" refers to a gene as found in nature with its own regulatory sequences; such a gene is located in its natural location in the genome of a host cell. A "chimeric" gene refers to any gene that is not a native gene, comprising regulatory and coding sequences that are not found together in nature (i.e., the regulatory and coding regions are heterologous with each other). Accordingly, a chimeric gene may comprise regulatory sequences and coding sequences that are derived from different sources, or regulatory sequences and coding sequences derived from the same source, but arranged in a manner different than that found in nature. A "foreign" or "heterologous" gene can refer to a gene that is introduced into the host organism by gene transfer. Foreign/heterologous genes can comprise native genes inserted into a non-native organism, native genes introduced into a new location within the native host, or chimeric genes. Polynucleotide sequences in certain embodiments disclosed herein are heterologous. A "transgene" is a gene that has been introduced into the genome by a gene delivery procedure (e.g., transformation). A "codon-optimized" open reading frame has its frequency of codon usage designed to mimic the frequency of preferred codon usage of the host cell.

As used herein, the term "polypeptide" is defined as a chain of amino acid residues, usually having a defined sequence. As used herein the term polypeptide is interchangeable with the terms "peptides" and "proteins". Typical amino acids contained in polypeptides herein include (respective three- and one-letter codes shown parenthetically): alanine (Ala, A), arginine (Arg, R), asparagine (Asn, N), aspartic acid (Asp, D), cysteine (Cys, C), glutamic acid (Glu, E), glutamine (Gln, Q), glycine (Gly, G), histidine (His, H), isoleucine (Ile, I), leucine (Leu, L), lysine (Lys, K), methionine (Met, M), phenylalanine (Phe, F), proline (Pro, P), serine (Ser, S), threonine (Thr, T), tryptophan (Trp, W), tyrosine (Tyr, Y), valine (Val, V).

The term "heterologous" means not naturally found in the location of interest. For example, a heterologous gene can be one that is not naturally found in a host organism, but that is introduced into the host organism by gene transfer. As another example, a nucleic acid molecule that is present in a chimeric gene can be characterized as being heterologous, as such a nucleic acid molecule is not naturally associated with the other segments of the chimeric gene (e.g., a promoter can be heterologous to a coding sequence).

A "non-native" amino acid sequence or polynucleotide sequence comprised in a cell or organism herein does not occur in a native (natural) counterpart of such cell or organism. Such an amino acid sequence or polynucleotide sequence can also be referred to as being heterologous to the cell or organism.

"Regulatory sequences" as used herein refer to nucleotide sequences located upstream of a gene's transcription start site (e.g., promoter), 5' untranslated regions, introns, and 3' non-coding regions, and which may influence the transcription, processing or stability, and/or translation of an RNA transcribed from the gene. Regulatory sequences herein may include promoters, enhancers, silencers, 5' untranslated leader sequences, introns, polyadenylation recognition sequences, RNA processing sites, effector binding sites, stem-loop structures, and other elements involved in regulation of gene expression. One or more regulatory elements herein may be heterologous to a coding region herein.

A "promoter" as used herein refers to a DNA sequence capable of controlling the transcription of RNA from a gene. In general, a promoter sequence is upstream of the transcription start site of a gene. Promoters may be derived in their entirety from a native gene, or be composed of different elements derived from different promoters found in nature, or even comprise synthetic DNA segments. Promoters that cause a gene to be expressed in a cell at most times under all circumstances are commonly referred to as "constitutive promoters". A promoter may alternatively be inducible. One or more promoters herein may be heterologous to a coding region herein.

A "strong promoter" as used herein refers to a promoter that can direct a relatively large number of productive initiations per unit time, and/or is a promoter driving a higher level of gene transcription than the average transcription level of the genes in a cell.

The terms "3' non-coding sequence", "transcription terminator", "terminator" and the like as used herein refer to DNA sequences located downstream of a coding sequence. This includes polyadenylation recognition sequences and other sequences encoding regulatory signals capable of affecting mRNA processing or gene expression.

As used herein, a first nucleic acid sequence is "hybridizable" to a second nucleic acid sequence when a single-stranded form of the first nucleic acid sequence can anneal to the second nucleic acid sequence under suitable annealing conditions (e.g., temperature, solution ionic strength). Hybridization and washing conditions are well known and exemplified in Sambrook J, Fritsch E F and Maniatis T, *Molecular Cloning: A Laboratory Manual,* 2nd ed., Cold Spring Harbor Laboratory: Cold Spring Harbor, N.Y. (1989), which is incorporated herein by reference, particularly Chapter 11 and Table 11.1.

The term "DNA manipulation technique" refers to any technique in which the sequence of a DNA polynucleotide sequence is modified. Although the DNA polynucleotide sequence being modified can be used as a substrate itself for modification, it does not have to be physically in hand for certain techniques (e.g., a sequence stored in a computer can be used as the basis for the manipulation technique). A DNA manipulation technique can be used to delete and/or mutate one or more DNA sequences in a longer sequence. Examples of a DNA manipulation technique include recombinant DNA techniques (restriction and ligation, molecular cloning), polymerase chain reaction (PCR), and synthetic DNA methods (e.g., oligonucleotide synthesis and ligation). Regarding synthetic DNA techniques, a DNA manipulation technique can entail observing a DNA polynucleotide in silico, determining desired modifications (e.g., one or more deletions) of the DNA polynucleotide, and synthesizing a DNA polynucleotide that contains the desired modifications.

The term "in silico" herein means in or on an information storage and/or processing device such as a computer; done or produced using computer software or simulation, i.e., virtual reality.

The terms "upstream" and "downstream" as used herein with respect to polynucleotides refer to "5' of" and "3' of", respectively.

The term "expression" as used herein refers to (i) transcription of RNA (e.g., mRNA or a non-protein-coding RNA) from a coding region, and/or (ii) translation of a polypeptide from mRNA. Expression of a coding region of a polynucleotide sequence can be up-regulated or down-regulated in certain embodiments.

The term "operably linked" as used herein refers to the association of two or more nucleic acid sequences such that the function of one is affected by the other. For example, a promoter is operably linked with a coding sequence when it is capable of affecting the expression of that coding sequence. That is, the coding sequence is under the transcriptional control of the promoter. A coding sequence can be operably linked to one (e.g., promoter) or more (e.g., promoter and terminator) regulatory sequences, for example.

The term "recombinant" when used herein to characterize a DNA sequence such as a plasmid, vector, or construct refers to an artificial combination of two otherwise separated segments of sequence, e.g., by chemical synthesis and/or by manipulation of isolated segments of nucleic acids by genetic engineering techniques.

The term "transformation" as used herein refers to the transfer of a nucleic acid molecule into a host organism or host cell by any method. A nucleic acid molecule that has been transformed into an organism/cell may be one that replicates autonomously in the organism/cell, or that integrates into the genome of the organism/cell, or that exists transiently in the cell without replicating or integrating. Non-limiting examples of nucleic acid molecules suitable for transformation are disclosed herein, such as plasmids and linear DNA molecules. Host organisms/cells herein containing a transforming nucleic acid sequence can be referred to as "transgenic", "recombinant", "transformed", "engineered", as a "transformant", and/or as being "modified for exogenous gene expression", for example.

The terms "sequence identity", "identity" and the like as used herein with respect to polynucleotide or polypeptide sequences refer to the nucleic acid residues or amino acid residues in two sequences that are the same when aligned for maximum correspondence over a specified comparison window. Thus, "percentage of sequence identity", "percent identity" and the like refer to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. It would be understood that, when calculating sequence identity between a DNA sequence and an RNA sequence, T residues of the DNA sequence align with, and can be considered "identical" with, U residues of the RNA sequence. For purposes of determining "percent complementarity" of first and second polynucleotides, one can obtain this by determining (i) the percent identity between the first polynucleotide and the complement sequence of the second polynucleotide (or vice versa), for example, and/or (ii) the percentage of bases between the first and second polynucleotides that would create canonical Watson and Crick base pairs.

Percent identity can be readily determined by any known method, including but not limited to those described in: 1) *Computational Molecular Biology* (Lesk, A. M., Ed.) Oxford University: NY (1988); 2) *Biocomputing: Informatics and Genome Projects* (Smith, D. W., Ed.) Academic: NY (1993); 3) *Computer Analysis of Sequence Data, Part I* (Griffin, A. M., and Griffin, H. G., Eds.) Humana: NJ (1994); 4) *Sequence Analysis in Molecular Biology* (von Heinje, G., Ed.) Academic (1987); and 5) *Sequence Analysis Primer* (Gribskov, M. and Devereux, J., Eds.) Stockton: NY (1991), all of which are incorporated herein by reference.

Preferred methods for determining percent identity are designed to give the best match between the sequences tested. Methods of determining identity and similarity are codified in publicly available computer programs, for example. Sequence alignments and percent identity calculations can be performed using the MEGALIGN program of the LASERGENE bioinformatics computing suite (DNASTAR Inc., Madison, Wis.), for example. Multiple alignment of sequences can be performed, for example, using the Clustal method of alignment which encompasses several varieties of the algorithm including the Clustal V method of alignment (described by Higgins and Sharp, *CABIOS.* 5:151-153 (1989); Higgins, D. G. et al., *Comput. Appl. Biosci.,* 8:189-191 (1992)) and found in the MEGALIGN v8.0 program of the LASERGENE bioinformatics computing suite (DNASTAR Inc.). For multiple alignments, the default values can correspond to GAP PENALTY=10 and GAP LENGTH PENALTY=10. Default parameters for pairwise alignments and calculation of percent identity of protein sequences using the Clustal method can be KTUPLE=1, GAP PENALTY=3, WINDOW=5 and DIAGONALS SAVED=5. For nucleic acids, these parameters can be KTUPLE=2, GAP PENALTY=5, WINDOW=4 and DIAGONALS SAVED=4. Additionally, the Clustal W method of alignment can be used (described by Higgins and Sharp, *CABIOS.* 5:151-153 (1989); Higgins, D. G. et al., *Comput. Appl. Biosci.* 8:189-191(1992); Thompson, J. D. et al, *Nucleic Acids Research,* 22 (22): 4673-4680, 1994) and found in the MEGALIGN v8.0 program of the LASER-GENE bioinformatics computing suite (DNASTAR Inc.). Default parameters for multiple alignment (protein/nucleic acid) can be: GAP PENALTY=10/15, GAP LENGTH PENALTY=0.2/6.66, Delay Divergent Seqs (%)=30/30, DNA Transition Weight=0.5, Protein Weight Matrix=Gonnet Series, DNA Weight Matrix=IUB.

Various polypeptide amino acid sequences and polynucleotide sequences are disclosed herein as features of certain embodiments. Variants of these sequences that are at least about 70-85%, 85-90%, or 90%-95% identical to the sequences disclosed herein can be used or referenced. Alternatively, a variant amino acid sequence or polynucleotide sequence can have at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% A identity with a sequence disclosed herein. The variant amino acid sequence or polynucleotide sequence has the same function/activity of the disclosed sequence, or at least about 80%, 81%, 82%, 83%, 84%, 85%, 86%, 87%, 88%, 89%, 90%, 91%, 92%, 93%, 94%, 95%, 96%, 97%, 98%, or 99% of the function/activity of the disclosed sequence. Any polypeptide amino acid sequence disclosed herein not beginning with a methionine can typically further comprise at least a start-methionine at the N-terminus of the amino acid sequence. In contrast, any polypeptide amino acid sequence disclosed herein beginning with a methionine can optionally lack such a methionine residue.

The terms "aligns with", "corresponds with", and the like can be used interchangeably herein. Some embodiments herein relate to a glucosyltransferase comprising at least one amino acid substitution at a position corresponding with at least one particular amino acid residue of SEQ ID NO:62. An amino acid position of a glucosyltransferase or subsequence thereof (e.g., catalytic domain or catalytic domain plus glucan-binding domains) (can refer to such an amino acid position or sequence as a "query" position or sequence) can be characterized to correspond with a particular amino acid residue of SEQ ID NO:62 (can refer to such an amino acid position or sequence as a "subject" position or sequence) if (1) the query sequence can be aligned with the subject sequence (e.g., where an alignment indicates that the query sequence and the subject sequence [or a subsequence of the subject sequence] are at least about 30%, 40%, 50%, 60%, 70%, 80%, or 90% identical), and (2) if the query amino acid position directly aligns with (directly lines up against) the subject amino acid position in the alignment of (1). In general, one can align a query amino acid sequence with a subject sequence (SEQ ID NO:62 or a subsequence of SEQ ID NO:62) using any alignment algorithm, tool and/or software described disclosed herein (e.g., BLASTP, ClustalW, ClustalV, Clustal-Omega, EMBOSS) to determine percent identity. Just for further example, one can align a query sequence with a subject sequence herein using the Needleman-Wunsch algorithm (Needleman and Wunsch, *J. Mol. Biol.* 48:443-453, 1970) as implemented in the Needle program of the European Molecular Biology Open Software Suite (EMBOSS [e.g., version 5.0.0 or later], Rice et al., *Trends Genet.* 16:276-277, 2000). The parameters of such an EMBOSS alignment can comprise, for example: gap open penalty of 10, gap extension penalty of 0.5, EBLOSUM62 (EMBOSS version of BLOSUM62) substitution matrix.

The numbering of particular amino acid residues of SEQ ID NO:62 herein (e.g., Leu-373, Leu-428, Ala-472, Ala-510, Leu-513, Met-529, Phe-607, Asn-613, Gln-616, Ser-631, Gly-633, Phe-634, Thr-635, or Phe-951) is with respect to the full-length amino acid sequence of SEQ ID NO:62. The first amino acid (i.e., position 1, Met-1) of SEQ ID NO:62 is at the start of the signal peptide. Unless otherwise disclosed, substitutions herein are with respect to the full-length amino acid sequence of SEQ ID NO:62.

A "non-native glucosyltransferase" herein (alternatively, "mutant", "variant", "modified" and like terms can likewise be used to describe such a glucosyltransferase) has at least one amino acid substitution at a position corresponding with a particular amino acid residue (e.g., Leu-373, Leu-428, Ala-472, Ala-510, Leu-513, Met-529, Phe-607, Asn-613, Gln-616, Ser-631, Gly-633, Phe-634, Thr-635, or Phe-951) of SEQ ID NO:62. In most cases, such at least one amino acid substitution is in place of the amino acid residue(s) that normally (natively) occurs at the same position in the native counterpart (parent) of the non-native glucosyltransferase. The amino acid normally occurring at the relevant site in the native counterpart glucosyltransferase often is the same as (or conserved with) the particular amino acid residue (e.g., Leu-373, Leu-428, Ala-472, Ala-510, Leu-513, Met-529, Phe-607, Asn-613, Gln-616, Ser-631, Gly-633, Phe-634, Thr-635, or Phe-951) of SEQ ID NO:62 for which the alignment is made. A non-native glucosyltransferase optionally can have other amino acid changes (mutations, deletions, and/or insertions) relative to its native counterpart sequence.

It may be instructive to illustrate a substitution/alignment herein. SEQ ID NO:69 (GENBANK Acc. No. BAC07265.1, GI No. 22138845) is a native glucosyltransferase of *Streptococcus sobrinus.* It is noted that Phe-886 of SEQ ID NO:69 corresponds with Phe-951 of SEQ ID NO:62 (alignment not shown). If SEQ ID NO:69 is mutated at position 886 to substitute the Phe residue with a different residue (e.g., Tyr), then it can be stated that the position 886-mutated version of SEQ ID NO:69 represents a non-native glucosyltransferase having an amino acid substitution at a position corresponding with Phe-951 of SEQ ID NO:62, for example. As another example illustrating a substitution/alignment herein, it is noted that Leu-193 of SEQ ID NO:12 corresponds with Leu-373 of SEQ ID NO:62 (alignment not shown). If SEQ ID NO:12 is mutated at position 193 to substitute the Leu residue with a different residue (e.g., Gln), then it can be stated that the position 193-mutated version of SEQ ID NO:12 represents a non-native glucosyltransferase having an amino acid substitution at a position corresponding with Leu-373 of SEQ ID NO:62, for example.

The term "isolated" means a substance (or process) in a form or environment that does not occur in nature. Non-limiting examples of isolated substances include (1) any non-naturally occurring substance (e.g., a non-native glucosyltransferase herein), (2) any substance including, but not limited to, any host cell, enzyme, variant, nucleic acid, protein, peptide, cofactor, or carbohydrate/saccharide that is at least partially removed from one or more or all of the naturally occurring constituents with which it is associated in nature; (3) any substance modified by the hand of man relative to that substance found in nature (e.g., a non-native glucosyltransferase herein); or (4) any substance modified by increasing the amount of the substance relative to other components with which it is naturally associated. It is believed that the embodiments (e.g., enzymes and reaction compositions) disclosed herein are synthetic/man-made, and/or have properties that are not naturally occurring.

The term "increased" as used herein can refer to a quantity or activity that is at least about 1%, 2%, 3%, 4%, 5%, 6%, 7%, 8%, 9%, 10%, 11%, 12%, 13%, 14%, 15%, 16%, 17%, 18%, 19%, 20%, 50%, 100%, or 200% more than the quantity or activity for which the increased quantity or activity is being compared. The terms "increased", "elevated", "enhanced", "greater than", "improved" and the like are used interchangeably herein. These terms can be used to characterize the "over-expression" or "up-regulation" of a polynucleotide encoding a protein, for example.

While advances have been made in producing glucan polymers using glucosyltransferase enzymes, less attention appears to have been drawn to improving the glucan yields of such enzymes. Addressing this technological gap, disclosed herein are glucosyltransferases engineered to have modified amino acid sequences endowing these enzymes with enhanced glucan production properties.

Certain embodiments of the present disclosure concern a non-native glucosyltransferase comprising at least one amino acid substitution at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62, wherein the non-native glucosyltransferase synthesizes alpha-glucan comprising 1,3-linkages and/or 1,6-linkages, and wherein the non-native glucosyltransferase has:

(i) an alpha-glucan yield that is higher than the alpha-glucan yield of a second glucosyltransferase that only differs from the non-native glucosyltransferase at the substitution position(s), and/or (ii) a leucrose yield that is lower than the leucrose yield of the second glucosyltransferase.

Thus, in general, mutant glucosyltransferase enzymes are disclosed herein that can synthesize higher amounts of alpha-glucan, and/or lower yields of leucrose, which is a by-product often considered undesirable when the main goal is alpha-glucan synthesis.

A non-native glucosyltransferase herein synthesizes alpha-glucan comprising 1,3-linkages and/or 1,6-linkages. In some aspects, at least about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 69%, 70%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% of the glycosidic linkages of such an alpha-glucan can be alpha-1,3 linkages. The linkage profile of an alpha-glucan can optionally be characterized as having a range between any two of these values. The other linkages in any of these aspects having 1%-99% alpha-1,3 linkages can be alpha-1,6, and/or not include any alpha-1,4 or alpha-1,2 linkages, for example. Still, in other aspects, about 100% of the glycosidic linkages of an alpha-glucan can be alpha-1,6 linkages.

Alpha-glucan in some aspects can have, for example, less than 10%, 9%, 8%, 7%, 6%, 5%, 4%, 3%, 2%, or 1% of alpha-1,2 or alpha-1,4 glycosidic linkages. In another embodiment, an alpha-glucan only has alpha-1,3 and/or alpha-1,6 linkages.

Alpha-glucan in some aspects can be linear/unbranched. Alternatively, there can be branches in an alpha-glucan herein. For example, an alpha-glucan can have less than about 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, 011% branch points as a percent of the linkages in the polymer.

In certain aspects, an alpha-glucan can have a molecular weight in $DP_w$ or $DP_n$ of at least about 100. For example, the $DP_w$ or $DP_n$ can be at least about 100, 150, 200, 250, 300, 350, 400, 450, 500, 550, 600, 650, 700, 750, 800, 850, 900, 950, 1000, 1100, or 1200. The molecular weight of an alpha-glucan can optionally be expressed as a range between any two of these values. These molecular weights particularly apply, for example, to alpha-1,3-glucan herein.

Still, in some aspects, an alpha-glucan can have a DP of at least about 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 100, 150, 200, or 250. The DP of an alpha-glucan can optionally be expressed as a range between any two of these values. Particular examples of such an alpha-glucan include (i) those with a DP of less than 8 or 9 and that have mostly (e.g., >80-90%) or all alpha-1,3 linkages, and (ii) those with mostly (e.g., >80-90%) or all alpha-1,6 linkages.

Further still, in some aspects, an alpha-glucan can have an Mw of at least about 1, 5, 10, 15, 20, 25, 50, 60, 70, 80, 90, 100, 110, 120, 130, 140, 150, 160, 170, 180, 190, or 200 million Daltons. The Mw of an alpha-glucan can optionally be expressed as a range between any two of these values. Particular examples of such an alpha-glucan include dextrans with at least about 85% or 90% alpha-1,6 linkages.

An alpha-glucan produced by a non-native glucosyltransferase herein can be water-insoluble or water-soluble. Alpha-1,3-glucan herein is typically insoluble in most aqueous settings, whereas dextran is typically soluble in most aqueous settings. In general, the solubility of a glucan polymer in an aqueous system herein is related to its linkage type, molecular weight, and/or degree of branching. Alpha-1,3-glucan is generally insoluble at a $DP_w$ of 8 or 9 and above in neutral (e.g., pH 6-8) aqueous conditions.

Any of the foregoing linkage profiles, molecular weight profiles, and/or solubility profiles, for example, can be combined herein to appropriately characterize an alpha-glucan product of a non-native glucosyltransferase of the present disclosure. In some aspects, the linkage, molecular weight, and/or solubility profile of an alpha-glucan product herein can be as disclosed in any of the following publications, all of which are incorporated herein by reference: U.S. Pat. Nos. 7,000,000 and 8,871,474; U.S. Patent Appl. Publ. Nos. 2015/0232819, and 2016/0122445; and International Patent Appl. Publ. Nos. WO2015/183721, WO2015/183724, WO2015/183729, WO2015/183722, WO2015/183726 and WO2015/183714.

A non-native glucosyltransferase, for example, can comprise the amino acid sequence of any glucosyltransferase disclosed in the following publications that is capable of producing alpha-glucan as presently disclosed, but with the exception that the non-native glucosyltransferase has at least one amino acid substitution at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62: U.S. Pat. Nos. 7,000,000 and 8,871,474; U.S. Patent Appl. Publ. Nos. 2015/0232819, and 2016/0122445; and International Patent Appl. Publ. Nos. WO2015/183721, WO2015/183724, WO2015/183729, WO2015/183722, WO2015/183726 and WO2015/183714, all of which are incorporated herein by reference. In some aspects, such a non-native glucosyltransferase (i) has at least one of the foregoing substitutions, and (ii) comprises an amino acid sequence that is at least about 90%, 91%, 92%, 93%, 94%, 95%, 96%, 97%, 98%, 99%, or 99.5% identical to the amino acid sequence of the respective counterpart/parent glucosyltransferase not having the at least one substitution.

In some aspects, a non-native glucosyltransferase (i) has at least one amino acid substitution at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62, and (ii) comprises or consists of an amino acid sequence that is at least about 90%, 91%, 92%, 93%, 94%, 95%, 96%, 97%, 98%, 99%, or 99.5% identical to SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 59, 68 (or positions 37-1338 thereof), 69 (or positions 37-1554 or 170-1554 thereof), or 70. Certain information regarding alpha-glucan products of several glucosyltransferases with some of these amino acid sequences is provided in Table 2.

TABLE 2

GTF Enzymes and Related Alpha-Glucan Products[a]

| GTF ID | SEQ ID NO. | Reducing Sugars | Insoluble Product | % alpha-1,3 | % alpha-1,6 | $DP_n$ |
|---|---|---|---|---|---|---|
| 0874 | 2 | yes | yes | 100 | 0 | 60 |
| 6855 | 4 | yes | yes | 100 | 0 | 440 |
| 2379 | 6 | yes | yes | 37 | 63 | 310 |
| 7527 | 8 | yes | yes | 100 | 0 | 440 |
| 1724 | 10 | yes | yes | 100 | 0 | 250 |
| 0544 | 12 | yes | yes | 62 | 36 | 980 |
| 5926 | 14 | yes | yes | 100 | 0 | 260 |
| 4297 | 16 | yes | yes | 31 | 67 | 800 |
| 5618 | 18 | yes | yes | 34 | 66 | 1020 |
| 2765 | 20 | yes | yes | 100 | 0 | 280 |
| 4700 | 22 | yes | no | | | |
| 1366 | 24 | yes | no | <30 | | |
| 0427 | 26 | yes | yes | 100 | 0 | 120 |
| 2919 | 28 | yes | yes | 100 | 0 | 250 |
| 2678 | 30 | yes | yes | 100 | 0 | 390 |
| 2381 | 32 | yes | no | | | |
| 3929 | 34 | yes | yes | 100 | 0 | 280 |
| 6907 | 36 | yes | no | <30 | | |
| 6661 | 38 | yes | no | <30 | | |
| 0339 | 40 | yes | no | <30 | | |
| 0088 | 42 | yes | no | <30 | | |
| 9358 | 44 | yes | no | <30 | | |
| 8242 | 46 | yes | no | <30 | | |
| 3442 | 48 | yes | no | <30 | | |
| 7528 | 50 | yes | no | <30 | | |
| 3279 | 52 | yes | no | <30 | | |
| 6491 | 54 | yes | no | | | |
| 6889 | 56 | yes | no | | | |
| 4154 | 58 | yes | no | | | |

[a]GTF reactions and product analyses were performed as follows. Reactions were prepared comprising sucrose (50 g/L), potassium phosphate buffer (pH 6.5, 20 mM) and a GTF enzyme (2.5% bacterial cell extract by volume; extracts prepared according to U.S. Appl. No. 62/180,779 or US2017/0002335, in a manner similar to procedure disclosed in U.S. Pat. No. 8,871,474). After 24-30 hours at 22-25° C., insoluble product, if present, was harvested by centrifugation, washed three times with water, washed once with ethanol, and dried at 50° C.C for 24-30 hours. Approximate linkages and $DP_n$ are shown for each insoluble product, if present. Linkage measurements (if available) are shown for each soluble product (for reactions not producing any insoluble product). Linkages and $DP_n$ were determined by $^{13}$C NMR and SEC, respectively.

In some aspects, a non-native glucosyltransferase (i) has at least one amino acid substitution at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62, and (ii) comprises or consists of a glucosyltransferase catalytic domain that is at least about 90%, 91%, 92%, 93%, 94%, 95%, 96%, 97%, 98%, 99%, or 99.5% identical to amino acid residues 54-957 of SEQ ID NO:65, residues 55-960 of SEQ ID NO:30, residues 55-960 of SEQ ID NO:4, residues 55-960 of SEQ ID NO:28, or residues 55-960 of SEQ ID NO:20. Such a non-native glucosyltransferase, for instance, is believed to be able to produce alpha-glucan that is water-insoluble and comprise at least about 50% (e.g., ≥90% or 95%) alpha-1,3 linkages, and optionally further have a $DP_w$ of at least 100. It is noted that a glucosyltransferase with amino acid positions 54-957 of SEQ ID NO:65 can produce alpha-1,3-glucan with 100% alpha-1,3 linkages and a $DP_w$ of at least 400 (data not shown, refer to Table 6 of U.S. Pat. Appl. No. 62/180,779 or U.S. Pat. Appl. Publ. No. 2017/0002335, which are incorporated herein by reference), for example. It is further noted that SEQ ID NOs:65 (GTF 7527), 30 (GTF 2678), 4 (GTF 6855), 28 (GTF 2919), and 20 (GTF 2765) each represent a glucosyltransferase that, compared to its respective wild type counterpart, lacks the signal peptide domain and all or a substantial portion of the variable domain. Thus, each of these glucosyltransferase enzymes has a catalytic domain followed by a glucan-binding domain. The approximate location of catalytic domain sequences in these enzymes is as follows: 7527 (residues 54-957 of SEQ ID NO:65), 2678 (residues 55-960 of SEQ ID NO:30), 6855 (residues 55-960 of SEQ ID NO:4), 2919 (residues 55-960 of SEQ ID NO:28), 2765 (residues 55-960 of SEQ ID NO:20). The amino acid sequences of the catalytic domains (approx.) of GTFs 2678, 6855, 2919 and 2765 have about 94.9%, 99.0%, 95.5% and 96.4% identity, respectively, with the approximate catalytic domain sequence of GTF 7527 (i.e., amino acids 54-957 of SEQ ID NO:65). Each of these particular glucosyltransferases (GTFs 2678, 6855, 2919 and 2765) can produce alpha-1,3-glucan with 100% alpha-1,3 linkages and a $DP_w$ of at least 400 (data not shown, refer to Table 4 of U.S. Pat. Appl. No. 62/180,779 or US2017/0002335). Based on this activity, and the relatedness (high percent identity) of the foregoing catalytic domains, it is contemplated that a non-native glucosyltransferase herein having one of the foregoing catalytic domains further with at least one of the foregoing amino acid substitutions can produce alpha-glucan comprising at least about 50% (e.g., 90% or 95%) alpha-1,3 linkages and a $DP_w$ of at least 100.

In some aspects, a non-native glucosyltransferase (i) has at least one amino acid substitution at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62, and (ii) comprises or consists of an amino acid sequence that is at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 81%, 62%, 63%, 64%, 65%, 66%, 67%, 69%, 70%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 99.5% identical to SEQ ID NO:62 or a subsequence thereof such as SEQ ID NO:4 (without start methionine thereof) or positions 55-960 of SEQ ID NO:4 (approximate catalytic domain).

Although it is believed that a non-native glucosyltransferase in certain aspects need only have a catalytic domain sequence with at least one amino acid substitution herein, the non-native glucosyltransferase can be comprised within a larger amino acid sequence. For example, a catalytic domain may be linked at its C-terminus to a glucan-binding domain, and/or linked at its N-terminus to a variable domain and/or signal peptide.

Although amino acid substitutions in a non-native glucosyltransferase are generally disclosed herein with respect to the corresponding positions in SEQ ID NO:62, such substitutions can alternatively be stated simply with respect to its position number in the sequence of the non-native glucosyltransferase itself, as convenience may dictate.

Still further examples of non-native glucosyltransferases can be any as disclosed herein and that include 1-300 (or any integer there between [e.g., 10, 15, 20, 25, 30, 35, 40, 45, or 50]) residues on the N-terminus and/or C-terminus. Such additional residues may be from a corresponding wild type sequence from which the glucosyltransferase enzyme is derived, or may be a heterologous sequence such as an epitope tag (at either N- or C-terminus) or a heterologous signal peptide (at N-terminus), for example. A non-native glucosyltransferase herein typically lacks an N-terminal signal peptide; such an enzyme can optionally be characterized as being mature if its signal peptide was removed during a secretion process.

A non-native glucosyltransferase herein can be derived from any microbial source, for example, such as a bacteria or fungus. Examples of bacterial glucosyltransferases are those derived from a *Streptococcus* species, *Leuconostoc* species, or *Lactobacillus* species. Examples of *Streptococcus* species include *S. salivarius, S. sobrinus, S. dentirousetti, S. downei, S. mutans, S. oralis, S. gallolyticus* and *S. sanguinis*. Examples of *Leuconostoc* species include *L. mesenteroides, L. amelibiosum, L. argentinum, L. carnosum, L. citreum, L. cremoris, L. dextranicum* and *L. fructosum*. Examples of *Lactobacillus* species include *L. acidophilus, L. delbrueckii, L. helveticus, L. salivarius, L. casei, L. curvatus, L. plantarum, L. sakei, L. brevis, L. buchneri, L. fermentum* and *L. reuteri*.

A non-native glucosyltransferase herein can be prepared by fermentation of an appropriately engineered microbial strain, for example. Recombinant enzyme production by fermentation is well known in the art using microbial species such as *E. coli*, *Bacillus* strains (e.g., *B. subtilis*), *Ralstonia eutropha*, *Pseudomonas fluorescens*, *Saccharomyces cerevisiae*, *Pichia pastoris*, *Hansenula polymorpha*, and species of *Aspergillus* (e.g., *A. awamori*) and *Trichoderma* (e.g., *T. reesei*) (e.g., see Adrio and Demain, *Biomolecules* 4:117-139, 2014, which is incorporated herein by reference). A nucleotide sequence encoding a non-native glucosyltransferase amino acid sequence is typically linked to a heterologous promoter sequence to create an expression cassette for the enzyme, and/or is codon-optimized accordingly. Such an expression cassette may be incorporated in a suitable plasmid or integrated into the microbial host chromosome, using methods well known in the art. The expression cassette may include a transcriptional terminator nucleotide sequence following the amino acid coding sequence. The expression cassette may also include, between the promoter sequence and glucosyltransferase amino acid coding sequence, a nucleotide sequence encoding a signal peptide (e.g., heterologous signal peptide) that is designed for direct secretion of the glucosyltransferase enzyme. At the end of fermentation, cells may be ruptured accordingly (generally when a signal peptide for secretion is not employed) and the glucosyltransferase enzyme can be isolated using methods such as precipitation, filtration, and/or concentration. Alternatively, a lysate or extract comprising a glucosyltransferase can be used without further isolation. If the glucosyltransferase was secreted (i.e., it is present in the fermentation broth), it can optionally be used as isolated from, or as comprised in, the fermentation broth. The activity of a glucosyltransferase enzyme can be confirmed by biochemical assay, such as measuring its conversion of sucrose to glucan polymer.

A non-native glucosyltransferase herein can comprise at least one amino acid substitution at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62. In some aspects, the amino acid substitution at a position corresponding with amino acid Asn-613 of SEQ ID NO:62 can be with a Val, Ile, Thr, Gly, Met, or Leu residue. In some aspects, the amino acid substitution at a position corresponding with amino acid Phe-951 of SEQ ID NO:62 can be with a Tyr residue. In some aspects, the amino acid substitution at a position corresponding with amino acid Ala-510 of SEQ ID NO:62 can be with a Glu, Ile, Val, or Asp residue. In some aspects, the amino acid substitution at a position corresponding with amino acid Phe-607 of SEQ ID NO:62 can be with a Trp, Tyr, or Asn residue. In some aspects, the amino acid substitution at a position corresponding with amino acid Gln-616 of SEQ ID NO:62 can be with a Glu residue. In some aspects, the amino acid substitution at a position corresponding with amino acid Leu-373 of SEQ ID NO:62 can be with a Gln, Ala, Val, Met, Phe, or Leu residue. In some aspects, the amino acid substitution at a position corresponding with amino acid Ala-472 of SEQ ID NO:62 can be with a Ser or Cys residue. In some aspects, the amino acid substitution at a position corresponding with amino acid Gly-633 of SEQ ID NO:62 can be with a Trp residue. In some aspects, the amino acid substitution at a position corresponding with amino acid Leu-513 of SEQ ID NO:62 can be with a Tyr, Phe, or Trp residue. In some aspects, the amino acid substitution at a position corresponding with amino acid Thr-635 of SEQ ID NO:62 can be with a Trp, His, or Tyr residue. In some aspects, the amino acid substitution at a position corresponding with amino acid Met-529 of SEQ ID NO:62 can be with a Leu or Asn residue. In some aspects, the amino acid substitution at a position corresponding with amino acid Phe-634 of SEQ ID NO:62 can be with an Ala residue. In some aspects, the amino acid substitution at a position corresponding with amino acid Ser-631 of SEQ ID NO:62 can be with a Thr, Asp, Glu, or Arg residue. In some aspects, the amino acid substitution at a position corresponding with amino acid Leu-428 of SEQ ID NO:62 can be with a Val residue. A non-native glucosyltransferase herein can comprise one, two, three, four, or more of the disclosed substitutions, for instance. A non-native glucosyltransferase in some aspects can comprise at least one amino acid substitution at a position corresponding with amino acid residue Val-552 of SEQ ID NO:62 (e.g., substitution with a Gly residue).

Suitable substitution sites, and examples of particular substitutions at these sites, can include those as listed in Table 3 in Example 1 (below) that are associated with (i) a decrease in leucrose production by at least about 5%, 10%, 15%, 20%, 25%, 30%, 35%, 40%, 45%, 50%, 55%, 60%, 65%, 70%, 75%, 80%, 85%, 90%, or 95%, and/or (ii) an increase in glucan yield by at least about 5%, 10%, 15%, 20%, 25%, 30%, 35%, 40%, 45%, 50%, 55%, 60%, 65%, 70%, 75%, 80%, 85%, 90%, 95%, 100%, 105%, 110%, 115%, 120%, 125%, 130%, 135%, 140%, 145%, or 150%. In some aspects, suitable substitutions include those as listed in Table 3 in Example 1 (below) that are associated with a decrease in glucose production by at least about 5%, 10%, 15%, 20%, 25%, 30%, 35%, 40%, 45%, 50%, 55%, 60%, 65%, 70%, 75%, or 80%. In some aspects, suitable substitutions include those as listed in Table 3 in Example 1 (below) that are associated with a decrease in gluco-oligosaccharide (oligomer) production by at least about 5%, 10%, 15%, 20%, 25%, 30%, 35%, 40%, 45%, 50%, 55%, 60%, or 65%. The foregoing substitutions as listed in Table 3 are as they correspond with the listed residue position number in SEQ ID NO:62. In some aspects, one or more substitutions are conserved or non-conserved substitutions; such conservation (or not) can be, for instance, with respect to the amino acid that occurs in the native glucosyltransferase from which the non-native glucosyltransferase is derived.

As disclosed above, a non-native glucosyltransferase herein can be based on any one of a variety of glucosyltransferase amino acid sequences. Simply for illustration purposes, examples of non-native glucosyltransferases comprising at least one amino acid substitution as presently disclosed include glucosyltransferases that: (i) comprise an amino acid sequence that is at least about 90% identical to residues 55-960 of SEQ ID NO:4, or an amino acid sequence that is at least about 90% identical to SEQ ID NO:4 (optionally without the start methionine of SEQ ID NO:4), and (ii) have at least one amino acid substitution as disclosed herein. For instance, SEQ ID NO:66 represents residues 55-960 of SEQ ID NO:4, but with a Glu residue at the position corresponding with amino acid Ala-510 of SEQ ID NO:62 (i.e., Glu substituting for Ala) (the substituting Glu is at position 279 of SEQ ID NO:66). Thus, a non-native glucosyltransferase in some aspects can comprise or consist of SEQ ID NO:66 or an amino acid sequence that is at least about 90%, 91%, 92%, 93%, 94%, 95%, 96%, 97%, 98%, 99%, or 99.5% identical to SEQ ID NO:66, but that has a Glu at position 279. In other aspects, a non-native glucosyltransferase can comprise or consist of SEQ ID NO:71 or an amino acid sequence that is at least about 90%, 91%, 92%, 93%, 94%, 95%, 96%, 97%, 98%, 99%, or 99.5% identical to SEQ ID NO:71, but that has a Glu at position 279.

Examples of non-native glucosyltransferases of the present disclosure can comprise two or more (multiple) amino acid substitutions, wherein at least one of such two or more substitutions is at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62. For instance, such a non-native glucosyltransferase can comprise two, three, four, five, or more amino acid substitutions, where at least one of the substitutions is from the foregoing list. Also for instance, a non-native glucosyltransferase can comprise two or three amino acid substitutions from the foregoing list, and optionally one or two other amino acid substitutions.

In some aspects, a non-native glucosyltransferase with multiple amino acid substitutions comprises at least one amino acid substitution at a position corresponding with amino acid residue Ala-510 or Phe-607 of SEQ ID NO:62. An example is a non-native glucosyltransferase comprising amino acid substitutions at both of these positions. Additional amino acid substitutions, if present, in these and other non-native glucosyltransferases disclosed herein having multiple substitutions can be at a position(s) corresponding with amino acid residue(s) Arg-741, Asn-743, Leu-784, Asp-820, Phe-929, Asp-948, and/or Arg-1172 of SEQ ID NO:62, for example. Just to illustrate, a non-native glucosyltransferase with multiple substitutions herein can include substitutions at either or both of positions corresponding with amino acid residues Arg-741 and/or Asn-743 of SEQ ID NO:62. Just to further illustrate, a non-native glucosyltransferase with multiple substitutions herein can include substitutions at positions Arg-741, Asp-948, and/or Arg-1172 of SEQ ID NO:62. More examples herein include a non-native glucosyltransferase comprising a combination of amino acid substitutions as follows (i-x), where each substitution corresponds with the respective amino acid residue of SEQ ID NO:62:

(i) Ala-510, Phe-607 and Arg-741;
(ii) Ala-510, Phe-607 and Asn-743;
(iii) Ala-510, Phe-607 and Asp-948;
(iv) Ala-510, Arg-741 and Asp-948;
(v) Ala-510, Phe-607, Arg-741 and Asp-948;
(vi) Ala-510, Phe-607, Arg-741 and Arg-1172;
(vii) Ala-510, Phe-607, Asp-820 and Asp-948;
(viii) Ala-510, Phe-607, Asp-948 and Arg-1172;
(ix) Ala-510, Phe-607, Asn-743, Asp-948 and Arg-1172; or
(x) Ala-510, Phe-607, Arg-741, Leu-784, Phe-929 and Arg-1172.

In some aspects of a non-native glucosyltransferase comprising multiple amino acid substitutions (e.g., embodiments i-x above), the amino acid substitution at a position corresponding with amino acid Ala-510 of SEQ ID NO:62 can be with an Asp, Glu, or other residue as presently disclosed (e.g., Ile or Val); the amino acid substitution at a position corresponding with amino acid Phe-607 of SEQ ID NO:62 can be with a Tyr or other residue as presently disclosed (e.g., Trp or Asn); the amino acid substitution at a position corresponding with amino acid Arg-741 of SEQ ID NO:62 can be with a Ser residue; the amino acid substitution at a position corresponding with amino acid Asn-743 of SEQ ID NO:62 can be with a Ser residue; the amino acid substitution at a position corresponding with amino acid Asp-948 of SEQ ID NO:62 can be with a Gly residue; the amino acid substitution at a position corresponding with amino acid Arg-1172 of SEQ ID NO:62 can be with a Cys residue; the amino acid substitution at a position corresponding with amino acid Asp-820 of SEQ ID NO:62 can be with a Gly residue; the amino acid substitution at a position corresponding with amino acid Leu-784 of SEQ ID NO:62 can be with a Gln residue; and/or the amino acid substitution at a position corresponding with amino acid Phe-929 of SEQ ID NO:62 can be with a Leu residue. Some examples of a non-native glucosyltransferase comprising multiple amino acid substitutions include those comprising the following combinations of substitutions (xi-xx), where each substitution corresponds with the respective amino acid residue of SEQ ID NO:62: (xi) A510D/F607Y/R741S, (xii) A510D/F607Y/N743S, (xiii) A510D/F607Y/D948G, (xiv) A510D/R741S/D948G, (xv) A510D/F607Y/R741S/D948G, (xvi) A510E/F607Y/R741S/R1172C, (xvii) A510D/F607Y/D820G/D948G, (xviii) A510D/F607Y/D948G/R1172C, (xix) A510D/F607Y/N743S/D948G/R1172C, or (xx) A510D/F607Y/R741S/L784Q/F929L/R1172C.

In some alternative aspects, a non-native glucosyltransferase can comprise at least one amino acid substitution at a position corresponding with amino acid residue Asn-743 (e.g., N743S) or Arg-741 (e.g., R741S) of SEQ ID NO:62 (with or without additional substitutions).

A non-native glucosyltransferase herein with multiple amino acid substitutions can be based on any of a variety of glucosyltransferase amino acid sequences as presently disclosed, for example. Simply for illustration purposes, examples of such a non-native glucosyltransferase include those with multiple substitutions as described above (e.g., any one of embodiments i-xx) and comprising or consisting of an amino acid sequence that is at least about 90%, 91%, 92%, 93%, 94%, 95%, 96%, 97%, 98%, 99%, or 99.5% identical to SEQ ID NO:65 (optionally without the start methionine of SEQ ID NO:65) or residues 54-957 of SEQ ID NO:65, SEQ ID NO:30 (optionally without the start methionine of SEQ ID NO:30) or residues 55-960 of SEQ ID NO:30, SEQ ID NO:4 (optionally without the start methionine of SEQ ID NO:4) or residues 55-960 of SEQ ID NO:4, SEQ ID NO:28 (optionally without the start methionine of SEQ ID NO:28) or residues 55-960 of SEQ ID NO:28, or SEQ ID NO:20 (optionally without the start methionine of SEQ ID NO:20) or residues 55-960 of SEQ ID NO:20.

A non-native glucosyltransferase herein can have (i) an alpha-glucan yield that is higher than the alpha-glucan yield of a second glucosyltransferase (e.g., parent glucosyltransferase) that only differs from the non-native glucosyltransferase at the substitution position(s), and/or (ii) a leucrose yield that is lower than the leucrose yield of the second glucosyltransferase. In some embodiments, a second glucosyltransferase to which a non-native glucosyltransferase is compared has a native amino acid residue at the substitution position(s). A second glucosyltransferase herein, for example, can be comprised of all of, or mostly, a native amino acid sequence. Thus, while a second glucosyltransferase herein can be a native glucosyltransferase in some aspects, it can be a prior-modified glucosyltransferase in other aspects (e.g., a glucosyltransferase with one or more other amino acid substitutions differing from the substitution[s] of the present disclosure). In some embodiments, a second glucosyltransferase to which a non-native glucosyltransferase is compared has a native amino acid residue(s) at the substitution position(s). Determining whether an amino acid residue is native can be done by comparing the second glucosyltransferase amino acid sequence to the native/wild type glucosyltransferase amino acid sequence from which the second glucosyltransferase is derived. Optionally, a non-native glucosyltransferase in some embodiments can be characterized as having higher selectivity toward alpha-glucan synthesis (as compared to by-product synthesis).

In some aspects, a non-native glucosyltransferase herein can have an alpha-glucan yield that is at least about 5%, 10%, 15%, 20%, 25%, 30%, 35%, 40%, 45%, 50%, 55%, 60%, 65%, 70%, 75%, 80%, 85%, 90%, 95%, 100%, 105%, 110%, 115%, 120%, 125%, 130%, 135%, 140%, 145%, 150%, 160%, 170%, 180%, 190%, 200%, 220%, 240%, 260%, 280%, 300%, 320%, or 340% higher than the alpha-glucan yield of a second glucosyltransferase as presently disclosed. In some additional or alternative embodiments, a non-native glucosyltransferase can have a decrease in leucrose yield by at least about 5%, 10%, 15%, 20%, 25%, 30%, 35%, 40%, 45%, 50%, 55%, 60%, 65%, 70%, 75%, 80%, 85%, 90%, or 95% compared to the leucrose yield of a second glucosyltransferase. These determinations (alpha-glucan and/or leucrose yield) can be made with respect to any glucan synthesis reaction/process as disclosed herein (e.g., taking into account initial sucrose conc., temperature, pH, and/or reaction time), and using any suitable measurement technique (e.g., HPLC or NIR spectroscopy). Typically, a comparison between non-native and second glucosyltransferases herein can be made under identical or similar reaction conditions. The yield of a glucosyltransferase reaction in some aspects can be measured based on the glucosyl component of the reaction.

In some embodiments, particularly those regarding a non-native glucosyltransferase that produces an insoluble alpha-glucan product such as alpha-1,3-glucan, the glucosyltransferase can exhibit a decrease in the yield of soluble gluco-oligosaccharides by at least about 5%, 10%, 15%, 20%, 25%, 30%, 35%, 40%, 45%, 50%, 55%, 60%, 65%, 70%, or 75% compared to the soluble gluco-oligosaccharide yield of a second glucosyltransferase. A soluble gluco-oligosaccharide in some aspects can be DP2-7 or DP2-8, and have any linkage profile disclosed herein. In some aspects, the DP is ≥7, or up to 10, 15, 20, or 25, but with a linkage profile allowing solubility (e.g., not over 90% or 95% alpha-1,3).

In some embodiments, particularly those regarding a non-native glucosyltransferase that produces an insoluble alpha-glucan product such as alpha-1,3-glucan, a non-native glucosyltransferase can exhibit a decrease in the yield of glucose by at least about 5%, 10%, 15%, 20%, 25%, 30%, 35%, 40%, 45%, 50%, 55%, 60%, 65%, 70%, 75%, or 80% compared to the glucose yield of a second glucosyltransferase.

Some embodiments disclosed herein concern a polynucleotide comprising a nucleotide sequence that encodes a non-native glucosyltransferase as presently disclosed (e.g., a non-native glucosyltransferase comprising at least one amino acid substitution at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62). Optionally, one or more regulatory sequences are operably linked to the nucleotide sequence, and preferably a promoter sequence is included as a regulatory sequence.

A polynucleotide comprising a nucleotide sequence encoding a non-native glucosyltransferase herein can be a vector or construct useful for transferring a nucleotide sequence into a cell, for example. Examples of a suitable vector/construct can be selected from a plasmid, yeast artificial chromosome (YAC), cosmid, phagemid, bacterial artificial chromosome (BAC), virus, or linear DNA (e.g., linear PCR product). A polynucleotide sequence in some aspects can be capable of existing transiently (i.e., not integrated into the genome) or stably (i.e., integrated into the genome) in a cell. A polynucleotide sequence in some aspects can comprise, or lack, one or more suitable marker sequences (e.g., selection or phenotype marker).

A polynucleotide sequence in certain embodiments can comprise one or more regulatory sequences operably linked to the nucleotide sequence encoding a non-native glucosyltransferase. For example, a nucleotide sequence encoding a non-native glucosyltransferase may be in operable linkage with a promoter sequence (e.g., a heterologous promoter). A promoter sequence can be suitable for expression in a cell (e.g., bacterial cell such as *E. coli* or *Bacillus*; eukaryotic cell such as a fungus, yeast, insect, or mammalian cell) or in an in vitro protein expression system, for example. Examples of other suitable regulatory sequences are disclosed herein (e.g., transcription terminator sequences).

Some aspects herein are drawn to a cell comprising a polynucleotide sequence as presently disclosed; such a cell can be any type disclosed herein (e.g., bacterial cell such as *E. coli* or *Bacillus*; eukaryotic cell such as a fungus, yeast, insect, or mammalian cell). A cell can optionally express a non-native glucosyltransferase encoded by the polynucleotide sequence. In some aspects, the polynucleotide sequence exists transiently (i.e., not integrated into the genome) or stably (i.e., integrated into the genome) in the cell.

Some embodiments disclosed herein concern reaction compositions comprising water, sucrose, and one or more non-native glucosyltransferases herein (e.g., a non-native glucosyltransferase comprising at least one amino acid substitution at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62). Such a reaction composition produces, at least, alpha-glucan comprising 1,3-linkages and/or 1,6-linkages as disclosed.

The temperature of a reaction composition herein can be controlled, if desired, and can be about 5-50° C., 20-40° C., 20-30° C., 20-25° C., for example.

The initial concentration of sucrose in a reaction composition herein can be about 20-400 g/L, 75-175 g/L, or 50-150 g/L, for example. In some aspects, the initial sucrose concentration is at least about 50, 75, 100, 150 or 200 g/L, or is about 50-600 g/L, 100-500 g/L, 50-100 g/L, 100-200 g/L, 150-450 g/L, 200-450 g/L, or 250-600 g/L. "Initial concentration of sucrose" refers to the sucrose concentration in a reaction composition just after all the reaction components have been added/combined (e.g., at least water, sucrose, non-native glucosyltransferase enzyme).

The pH of a reaction composition in certain embodiments can be about 4.0-8.0, 5.0-8.0, 5.5-7.5, or 5.5-6.5. In some aspects, the pH can be about 4.0, 4.5, 5.0, 5.5, 6.0, 6.5, 7.0, 7.5, or 8.0. The pH can be adjusted or controlled by the addition or incorporation of a suitable buffer, including but not limited to: phosphate, tris, citrate, or a combination thereof. The buffer concentration in a reaction composition herein can be about 0.1-300 mM, 0.1-100 mM, 10-100 mM, 10 mM, 20 mM, or 50 mM, for example.

A reaction composition can be contained within any vessel (e.g., an inert vessel/container) suitable for applying one or more of the reaction conditions disclosed herein. An inert vessel in some aspects can be of stainless steel, plastic, or glass (or comprise two or more of these components) and be of a size suitable to contain a particular reaction. An inert vessel can optionally be equipped with a stirring device.

A reaction composition herein can contain one, two, or more glucosyltransferase enzymes, for example, just as long that at least one of the enzymes is a non-native glucosyltransferase as presently disclosed. In some embodiments, only one or two glucosyltransferase enzymes is/are comprised in a reaction composition. A glucosyltransferase reaction herein can be, and typically is, cell-free (e.g., no whole cells present).

Any of the features disclosed herein (e.g., above and in the below Examples) regarding a reaction composition can characterize appropriate aspects of a glucan production method herein, and vice versa.

The present disclosure also concerns a method for producing alpha-glucan, the method comprising: (a) contacting at least water, sucrose, and at least one non-native glucosyltransferase as disclosed herein that produces an alpha-glucan, whereby alpha-glucan is produced; and b) optionally, isolating the alpha-glucan produced in step (a). Conducting such a method, which can optionally be characterized as a glucan synthesis method, is typically also performed when conducting a reaction composition herein.

A glucan synthesis method as presently disclosed comprises contacting at least water, sucrose, and a non-native glucosyltransferase herein that produces an alpha-glucan. These and optionally other reagents can be added altogether or in any order as discussed below. This step can optionally be characterized as providing a reaction composition comprising water, sucrose and a non-native glucosyltransferase enzyme that synthesizes alpha-glucan. The contacting step herein can be performed in any number of ways. For example, the desired amount of sucrose can first be dissolved in water (optionally, other components may also be added at this stage of preparation, such as buffer components), followed by addition of glucosyltransferase enzyme.

The solution may be kept still, or agitated via stirring or orbital shaking, for example. A glucan synthesis method can be performed by batch, fed-batch, continuous mode, or by any variation of these modes.

Completion of a reaction in certain embodiments can be determined visually (e.g., no more accumulation of insoluble glucan in certain embodiments), and/or by measuring the amount of sucrose left in the solution (residual sucrose), where a percent sucrose consumption of at least about 90%, 95%, or 99% can indicate reaction completion. A reaction of the disclosed process can be conducted for about 1 hour to about 2, 4, 6, 8, 10, 12, 14, 16, 18, 20, 22, 24, 36, 48, 60, 72, 96, 120, 144, or 168 hours, for example.

The yield of an alpha-glucan produced in some aspects of a glucan synthesis method herein can be at least about 40%, 45%, 50%, 55%, 60%, 65%, 70%, 75%, 80%, or 85%. This yield in some aspects can be measured based on the glucosyl component of the reaction. In some additional or alternative embodiments, the yield of leucrose can be less than about 18%, 17%, 16%, 15%, 14%, 13%, 12%, 11%, 10%, 9%, 8%, 7%, 6%, 5%, 4%, 3%, 2%, or 1%. Such a yield in alpha-glucan and/or leucrose in some aspects is achieved in a reaction conducted for about 16-24 hours (e.g., ~20 hours), and/or is as measured using HPLC or NIR spectroscopy.

Alpha-glucan produced in a glucan synthesis method herein optionally can be isolated. In certain embodiments, isolating an alpha-glucan product includes at least conducting a step of centrifugation, filtration, fractionation, chromatographic separation, dialysis, evaporation, or dilution. Simply as examples, insoluble alpha-glucan can be separated by centrifugation or filtration, whereas soluble alpha-glucan can be separated by chromatographic separation or dialysis. Isolation can optionally further comprise washing an alpha-glucan product one, two, or more times with water or other aqueous liquid, and/or drying the alpha-glucan product.

Any of the disclosed conditions for synthesizing an alpha-glucan, such as the foregoing or those described in the below Examples, can be applied to practicing a reaction composition as presently disclosed (and vice versa), and/or used to characterize features/activity of a non-native glucosyltransferase, accordingly.

The present disclosure also concerns a method of preparing a polynucleotide sequence encoding a non-native glucosyltransferase herein. This method comprises:
(a) identifying a polynucleotide sequence encoding a parent glucosyltransferase that (i) comprises an amino acid sequence that is at least about 30% identical to SEQ ID NO:4 or positions 55-960 of SEQ ID NO:4, and (ii) synthesizes alpha-glucan comprising 1,3-linkages and/or 1,6-linkages; and
(b) modifying the polynucleotide sequence identified in step (a) to substitute at least one amino acid (in the parent glucosyltransferase encoded thereby) at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62, thereby providing a polynucleotide sequence encoding a non-native glucosyltransferase that has:
(i) an alpha-glucan yield that is higher than the alpha-glucan yield of the parent glucosyltransferase, and/or
(ii) a leucrose yield that is lower than the leucrose yield of the parent glucosyltransferase.

Such a method can optionally further comprise using a polynucleotide prepared in this manner in a method of expressing the non-native glucosyltransferase encoded by the polynucleotide. Such an expression method can follow any heterologous protein expression method as known in the art, for example. The present method of preparing a polynucleotide can optionally alternatively be characterized as a method of increasing the product yield of a glucosyltransferase.

Identification step (a) herein can, in some instances, comprise identifying an amino acid sequence of a parent glucosyltransferase enzyme. A polynucleotide sequence could be determined from this amino acid sequence according to the genetic code (codons), such as the genetic code used in the species from which the parent glucosyltransferase was identified.

Identifying a polynucleotide encoding a parent glucosyltransferase herein can be performed (a) in silico, (b) with a method comprising a nucleic acid hybridization step, (c) with a method comprising a protein sequencing step, and/or (d) with a method comprising a protein binding step, for example.

Regarding in silico detection, the amino acid sequences of candidate parent glucosyltransferase enzymes (and/or nucleotide sequences encoding such glucosyltransferase enzymes) stored in a computer or database (e.g., public databases such as GENBANK, EMBL, REFSEQ, GENEPEPT, SWISS-PROT, PIR, PDB) can be reviewed in silico to identify a glucosyltransferase enzyme comprising an amino acid sequence that is at least about 30% 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 69%, 70%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 99.5% identical to SEQ ID NO:4 (optionally without start methionine thereof) or positions 55-960 of SEQ ID NO:4 (approximate catalytic domain), for example. Such review could comprise using any means known in the art such as through use of an alignment algorithm or software as described above (e.g., BLASTN, BLASTP, ClustalW, ClustalV, Clustal-Omega, EMBOSS). It is noted simply for reference purposes that SEQ ID NO:4 without its start methionine is a subsequence of SEQ ID NO:62.

Identifying a parent glucosyltransferase as disclosed above can optionally be performed via a method comprising a nucleic acid hybridization step. Such a method can comprise using DNA hybridization (e.g., Southern blot, dot blot), RNA hybridization (e.g., northern blot), or any other method that has a nucleic acid hybridization step (e.g., DNA sequencing, PCR, RT-PCR, all of which may comprise hybridization of an oligonucleotide), for example. A polynucleotide sequence encoding SEQ ID NO:4 or a subsequence thereof (e.g., positions 55-960 of SEQ ID NO:4) can be used as a probe, for example, in such a hybridization. Conditions and parameters for carrying out hybridization methods in general are well known and disclosed, for example, in Sambrook J, Fritsch E F and Maniatis T, *Molecular Cloning: A Laboratory Manual*, Cold Spring Harbor Laboratory: Cold Spring Harbor, N.Y. (1989); Silhavy T J, Bennan M L and Enquist L W, *Experiments with Gene Fusions*, Cold Spring Harbor Laboratory: Cold Spring Harbor, N Y (1984); Ausubel F M et al., *Current Protocols in Molecular Biology*, published by Greene Publishing Assoc. and Wiley-Interscience, Hoboken, N.J. (1987); and Innis M A, Gelfand D H, Sninsky J J and White T J (Editors), *PCR Protocols: A Guide to Methods and Applications*, Academic Press, Inc., San Diego, Calif. (1990).

Identifying a parent glucosyltransferase as disclosed above can optionally be performed via a method comprising a protein sequencing step. Such a protein sequencing step can comprise one or more procedures such as N-terminal amino acid analysis, C-terminal amino acid analysis, Edman degradation, or mass spectrometry, for example.

Identifying a parent glucosyltransferase as disclosed above can optionally be performed via a method comprising a protein binding step. Such a protein binding step can be performed using an antibody that binds to a motif or epitope within SEQ ID NO:4 (e.g., within positions 55-960 of SEQ ID NO:4), for example.

A polynucleotide identified in step (a) (i.e., before its modification in step [b]) can, in some aspects, encode a glucosyltransferase comprising an amino acid sequence that is identical to, or at least 90%, 91%, 92%, 93%, 94%, 95%, 96%, 97%, 98%, or 99% identical to, the amino acid sequence of any glucosyltransferase disclosed in Table 1. An alpha-glucan as produced by such a glucosyltransferase can be as disclosed herein, for example.

A method of preparing a polynucleotide sequence encoding a non-native glucosyltransferase herein comprises step (b) of modifying the polynucleotide sequence (encoding a parent glucosyltransferase) identified in step (a). Such modification substitutes at least one amino acid of the parent glucosyltransferase at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62. The non-native glucosyltransferase (encoded by the modified polynucleotide sequence) resulting from such one or more substitutions can be optionally be characterized as a "child glucosyltransferase" herein.

A suitable modification of a polynucleotide in step (b) can be made following any DNA manipulation technique known in the art. Modifying step (b) can optionally be performed in silico, followed by synthesis of the polynucleotide sequence encoding a non-native glucosyltransferase. For example, a polynucleotide sequence identified in step (a) can be manipulated in silico using a suitable sequence manipulation program/software (e.g., VECTOR NTI, Life Technologies, Carlsbad, Calif.; DNAStrider; DNASTAR, Madison, Wis.). Following such virtual manipulation, the modified polynucleotide sequence can be artificially synthesized by any suitable technique (e.g., annealing-based connection of oligonucleotides, or any technique disclosed in Hughes et al., *Methods Enzymol.* 498:277-309, which is incorporated herein by reference). It should be appreciated that the foregoing methodology is not believed to necessarily rely on having a pre-existing polynucleotide (encoding a parent glucosyltransferase) in hand.

Modifying step (b) can optionally be performed using a physical copy of a polynucleotide sequence identified in step (a) encoding a parent glucosyltransferase. As an example, such a polynucleotide can serve as a template for amplification using primers designed in a manner such that the amplified product encodes a non-native glucosyltransferase herein (e.g., refer to Innis et al., ibid.).

An amino acid substitution in this method can be any of those substitutions as disclosed herein at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62. Two or more amino acid substitutions as presently disclosed can be applied in some aspects. Essentially any non-native glucosyltransferase as presently disclosed can be encoded by a polynucleotide as prepared by this method, for instance, and consequently can have the higher alpha-glucan yield and/or lower leucrose yield profiles disclosed herein.

Non-limiting examples of compositions and methods disclosed herein include: 1. A non-native glucosyltransferase comprising at least one amino acid substitution at a position corresponding with amino acid residue Leu-373, Leu-428, Ala-472, Ala-510, Leu-513, Met-529, Val-552, Phe-607, Asn-613, Gln-616, Ser-631, Gly-633, Phe-634, Thr-635, or Phe-951 of SEQ ID NO:62, wherein the non-native glucosyltransferase synthesizes alpha-glucan comprising 1,3-linkages and/or 1,6-linkages, and wherein the non-native glucosyltransferase has: (i) an alpha-glucan yield that is higher than the alpha-glucan yield of a second glucosyltransferase that only differs from the non-native glucosyltransferase at the substitution position(s), and/or (ii) a leucrose yield that is lower than the leucrose yield of the second glucosyltransferase.
2. The non-native glucosyltransferase of embodiment 1, wherein: (i) the amino acid substitution at the position corresponding with amino acid residue Leu-373 is with a Gln, Ala, Val, Met, Phe, or Leu residue; (ii) the amino acid substitution at the position corresponding with amino acid residue Leu-428 is with a Val residue; (iii) the amino acid substitution at the position corresponding with amino acid residue Ala-472 is with a Ser or Cys residue; (iv) the amino acid substitution at the position corresponding with amino acid residue Ala-510 is with a Glu, Ile, Val, or Asp residue; (v) the amino acid substitution at the position corresponding with amino acid residue Leu-513 is with a Tyr, Phe, or Trp residue; (vi) the amino acid substitution at the position corresponding with amino acid residue Met-529 is with a Leu or Asn residue; the amino acid substitution at the position corresponding with amino acid residue Val-552 is with a Gly residue; (vii) the amino acid substitution at the position corresponding with amino acid residue Phe-607 is with a Trp, Tyr, or Asn residue; (viii) the amino acid substitution at the position corresponding with amino acid residue Asn-613 is with a Val, Ile, Thr, Gly, Met, or Leu residue; (ix) the amino acid substitution at the position corresponding with amino acid residue Gln-616 is with a Glu residue; (x) the amino acid substitution at the position corresponding with amino acid residue Ser-631 is with a Thr, Asp, Glu, or Arg residue; (xi) the amino acid substitution at the position corresponding with amino acid residue Gly-633 is with a Trp residue; (xii) the amino acid substitution at the position corresponding with amino acid residue Phe-634 is with an Ala residue; (xiii) the amino acid substitution at the position corresponding with amino acid residue Thr-635 is with a Trp, His, or Tyr residue; or (xiv) the amino acid substitution at the position corresponding with amino acid residue Phe-951 is with a Tyr residue.
3. The non-native glucosyltransferase of embodiment 1 or 2, comprising two or more amino acid substitutions, wherein at least one of the substitutions is at a position corresponding with amino acid residue Leu-373, Leu-428, Ala-472, Ala-510, Leu-513, Met-529, Phe-607, Asn-613, Gln-616, Ser-631, Gly-633, Phe-634, Thr-635, or Phe-951 of SEQ ID NO:62.
4. The non-native glucosyltransferase of embodiment 3, comprising at least one amino acid substitution at a position corresponding with amino acid residue Ala-510 or Phe-607 of SEQ ID NO:62.
5. The non-native glucosyltransferase of embodiment 4, comprising amino acid substitutions at positions corresponding with amino acid residues Ala-510 and Phe-607 of SEQ ID NO:62.
6. The non-native glucosyltransferase of embodiment 1, 2, 3, 4, or 5, wherein the alpha-glucan is insoluble and comprises at least about 50% alpha-1,3 linkages, and optionally wherein the alpha-glucan has a weight average degree of polymerization ($DP_w$) of at least 100.
7. The non-native glucosyltransferase of embodiment 6, comprising a catalytic domain that is at least about 90% identical to residues 55-960 of SEQ ID NO:4, residues 54-957 of SEQ ID NO:65, residues 55-960 of SEQ ID NO:30, residues 55-960 of SEQ ID NO:28, or residues 55-960 of SEQ ID NO:20.
8. The non-native glucosyltransferase of embodiment 7, comprising an amino acid sequence that is at least about 90% identical to SEQ ID NO:4, SEQ ID NO:65, SEQ ID NO:30, SEQ ID NO:28, or SEQ ID NO:20.
9. The non-native glucosyltransferase of embodiment 7 or 8, wherein the non-native glucosyltransferase synthesizes insoluble alpha-1,3-glucan having at least about 90% (or at least 95%) alpha-1,3-linkages.
10. The non-native glucosyltransferase of embodiment 1, 2, 3, 4, or 5, wherein the alpha-glucan is soluble and comprises at least about 75% alpha-1,6-linkages.
11. The non-native glucosyltransferase of embodiment 10, comprising an amino acid sequence that is at least about 90% identical to SEQ ID NO:68, positions 37-1338 of SEQ ID NO:68, SEQ ID NO:69, positions 37-1554 of SEQ ID NO:69, or positions 170-1554 of SEQ ID NO:69.
12. The non-native glucosyltransferase of embodiment 1, 2, 3, 4, 5, 6, 7, 8, 9, 10, or 11, wherein the alpha-glucan yield is at least about 10% higher than the alpha-glucan yield of the second glucosyltransferase.
13. A polynucleotide comprising a nucleotide sequence encoding a non-native glucosyltransferase according to embodiment 1, 2, 3, 4, 5, 6, 7, 8, 9, 10, 11, or 12, optionally wherein one or more regulatory sequences are operably linked to the nucleotide sequence, and preferably wherein the one or more regulatory sequences include a promoter sequence.
14. A reaction composition comprising water, sucrose, and a non-native glucosyltransferase according to embodiment 1, 2, 3, 4, 5, 6, 7, 8, 9, 10, 11, or 12.
15. A method of producing alpha-glucan comprising: (a) contacting at least water, sucrose, and a non-native glucosyltransferase enzyme according to embodiment 1, 2, 3, 4, 5, 6, 7, 8, 9, 10, 11, or 12, whereby alpha-glucan is produced; and (b) optionally, isolating the alpha-glucan produced in step (a).
16. A method of preparing a polynucleotide sequence encoding a non-native glucosyltransferase (e.g., of any one of embodiments 1-12), the method comprising: (a) identifying a polynucleotide sequence encoding a parent glucosyltransferase that (i) comprises an amino acid sequence that is at least about 30% identical to SEQ ID NO:4 or positions 55-960 of SEQ ID NO:4, and (ii) synthesizes alpha-glucan comprising 1,3-linkages and/or 1,6-linkages; and (b) modifying the polynucleotide sequence identified in step (a) to substitute at least one amino acid of the parent glucosyltransferase at a position corresponding with amino acid residue Leu-373, Leu-428, Ala-472, Ala-510, Leu-513, Met-529, Val-552, Phe-607, Asn-613, Gln-616, Ser-631, Gly-633, Phe-634, Thr-635, or Phe-951 of SEQ ID NO:62, thereby providing a polynucleotide sequence encoding a non-native glucosyltransferase that has: (i) an alpha-glucan yield that is higher than the alpha-glucan yield of the parent glucosyltransferase, and/or (ii) a leucrose yield that is lower than the leucrose yield of the parent glucosyltransferase.

17. The method of embodiment 16, wherein: (i) the amino acid substitution at the position corresponding with amino acid residue Leu-373 is with a Gln, Ala, Val, Met, Phe, or Leu residue; (ii) the amino acid substitution at the position corresponding with amino acid residue Leu-428 is with a Val residue; (iii) the amino acid substitution at the position corresponding with amino acid residue Ala-472 is with a Ser or Cys residue; (iv) the amino acid substitution at the position corresponding with amino acid residue Ala-510 is with a Glu, Ile, Val, or Asp residue; (v) the amino acid substitution at the position corresponding with amino acid residue Leu-513 is with a Tyr, Phe, or Trp residue; (vi) the amino acid substitution at the position corresponding with amino acid residue Met-529 is with a Leu or Asn residue; the amino acid substitution at the position corresponding with amino acid residue Val-552 is with a Gly residue; (vii) the amino acid substitution at the position corresponding with amino acid residue Phe-607 is with a Trp, Tyr, or Asn residue; (viii) the amino acid substitution at the position corresponding with amino acid residue Asn-613 is with a Val, Ile, Thr, Gly, Met, or Leu residue; (ix) the amino acid substitution at the position corresponding with amino acid residue Gin-616 is with a Glu residue; (x) the amino acid substitution at the position corresponding with amino acid residue Ser-631 is with a Thr, Asp, Glu, or Arg residue; (xi) the amino acid substitution at the position corresponding with amino acid residue Gly-633 is with a Trp residue; (xii) the amino acid substitution at the position corresponding with amino acid residue Phe-634 is with an Ala residue; (xiii) the amino acid substitution at the position corresponding with amino acid residue Thr-635 is with a Trp, His, or Tyr residue; or (xiv) the amino acid substitution at the position corresponding with amino acid residue Phe-951 is with a Tyr residue.

18. The method of embodiment 16 or 17, wherein the identifying step is performed: (a) in silico, (b) with a method comprising a nucleic acid hybridization step, (c) with a method comprising a protein sequencing step, and/or (d) with a method comprising a protein binding step; and/or wherein the modifying step is performed: (e) in silico, followed by synthesis of the polynucleotide sequence encoding the non-native glucosyltransferase enzyme, or (f) using a physical copy of the polynucleotide sequence encoding the parent glucosyltransferase.

EXAMPLES

The present disclosure is further exemplified in the following Examples. It should be understood that these Examples, while indicating certain preferred aspects herein, are given by way of illustration only. From the above discussion and these Examples, one skilled in the art can ascertain the essential characteristics of the disclosed embodiments, and without departing from the spirit and scope thereof, can make various changes and modifications to adapt the disclosed embodiments to various uses and conditions.

Example 1

Analysis of Amino Acid Sites Affecting Glucosyltransferase Selectivity Toward Alpha-Glucan Synthesis This Example describes screening for glucosyltransferase variants with improved selectivity toward alpha-glucan synthesis from sucrose. Another aim of this screening was to identify glucosyltransferase variants that exhibit reduced synthesis of by-products such as leucrose and gluco-oligosaccharides. Variants having either or both of these yield properties were identified.

The amino acid sequence of the glucosyltransferase used to prepare amino acid substitutions in this Example was SEQ ID NO:4 (GTF 6855), which essentially is an N-terminally truncated (signal peptide and variable region removed) version of the full-length wild type glucosyltransferase (represented by SEQ ID NO:62) from *Streptococcus salivarius* SK126 (see Table 1). Substitutions made in SEQ ID NO:4 can be characterized as substituting for native amino acid residues, as each amino acid residue/position of SEQ ID NO:4 (apart from the Met-1 residue of SEQ ID NO:4) corresponds accordingly with an amino acid residue/position within SEQ ID NO:62. In reactions comprising at least sucrose and water, the glucosyltransferase of SEQ ID NO:4 typically produces alpha-glucan having about 100% alpha-1,3 linkages and a $DP_w$ of 400 or greater (e.g., refer to U.S. Pat. Nos. 8,871,474 and 9,169,506, and U.S. Pat. Appl. Publ. No. 2017/0002336, which are incorporated herein by reference). This alpha-glucan product, which is insoluble, can be isolated following enzymatic synthesis via filtration, for example.

To summarize this Example, GTF 6855 variants (each with a single amino acid substitution) from site evaluation libraries (SEL) were each bacterially expressed, purified, and normalized to a concentration of 100 ppm. Each enzyme preparation was then screened (in triplicate) using sucrose as substrate in alpha-1,3 glucan synthesis reactions. In addition to determining the amount of alpha-1,3 glucan polymer produced in each reaction, the soluble sugar products (fructose, glucose, leucrose, gluco-oligosaccharides) and residual sucrose of each reaction were analyzed by HPLC after about a 20-hour incubation.

Plasmids for individually expressing various single amino acid-substituted variants of GTF 6855 (SEQ ID NO:4) in a *Bacillus subtilis* host were prepared. Such plasmids were prepared as follows. A DNA expression cassette having (operably linked in 5'-to-3' order) the *B. subtilis* aprE promoter, a codon-optimized sequence encoding SEQ ID NO:4 (GTF 6855), and a BPN' terminator was synthesized. This expression cassette was cloned into the pHYT replicating shuttle vector (forming pHYT-GTF6855) and transformed into *B. subtilis* CBS12-1. The pHYT vector was derived from pHY300PLK (Takara) by adding a terminator sequence (SEQ ID NO:67) after the tetracycline resistance gene using the BstEII and EcoRI sites. The HindIII site in pHY300PLK had been removed by cloning a linker sequence (not shown) into the BamHI and HindIII sites. The pHYT-GTF6855 plasmid was amplified and used for generating SELs. The resulting plasmids encoding single-amino acid substituted GTFs were sequenced to verify each substitution.

To produce GTF 6855 (SEQ ID NO:4) and single amino acid-substituted variants thereof, *B. subtilis* individually transformed with pHYT-GTF6855 or mutated versions thereof were cultivated in Tryptone Soya Broth (Oxoid Ltd., UK) and Grant's II medium. Heart infusion agar plates (Difco Laboratories, MI) were used to select transformants. Plasmid integrity was maintained by the addition of 25 µg/mL tetracycline. Each GTF targeted for expression was detected in the growth medium after incubation for about 6 hours at 37° C. After centrifugation and filtration, culture supernatants with expressed GTF were obtained. GTF enzyme present in the supernatant was purified to apparent homogeneity by affinity chromatography using washed (2×MILLIQ 1×25 mM NaH$_2$PO$_4$ pH 5.7 with intermediate centrifugation steps 100×g) SUPERDEX 200 resin (GE Healthcare). Each GTF was eluted with a 15% solution of Dextran T1 (Pharmacosmos) in 25 mM NaH$_2$PO$_4$ pH 5.7 by centrifugation 100×g. Each purified GTF was dialyzed against 25 mM NaH$_2$PO$_4$ pH 5.7 buffer (at least 100×) using a Harvard Apparatus 96-well DISPODIALYZER (10000-Dalton MWCO).

After dialysis, GTF enzyme concentration was determined by OD280 using purified GTF 6855 as a standard. Normalization of each purified GTF to 100 ppm was achieved by diluting appropriately with 25 mM NaH$_2$PO$_4$ pH 5.7. Protein concentration for each sample was confirmed using an AGILENT 1200 (Agilent Technologies) HPLC equipped with an AGILENT BIO SEC3 guard-column column (3 μm 100 Å (4.6×50 mm). Five (5) μL of sample was injected onto the column for each determination. Compounds were eluted with isocratic flow of 25 mM KH$_2$PO$_4$ pH 6.8+0.1 M NaCl for 1.3 min at 0.5 mL/min flow rate.

Each GTF (GTF 6855 and each variant thereof) was entered into a reaction with sucrose to determine yield and selectivity. Each reaction was performed as follows: 37.54 of 100 ppm enzyme sample (ppm based on a BSA calibration curve) was added to 262.54 of 86 g/L sucrose (75 g/L final) in 20 mM Na$_2$HPO$_4$/NaH$_2$PO$_4$ pH 5.7 and incubated overnight (about 20 hours) at 30° C. After this incubation, each reaction was quenched by incubation for 1 hour at 80° C. A 200-μL aliquot of each quenched reaction was filtered in vacuo via a 0.45-μm filter plate (Millipore 0.45-μm Hydrophilic) and each filtrate was diluted 5× (10 μL sample+ 40 μL 20 mM Na$_2$HPO$_4$/NaH$_2$PO$_4$) in preparation for HPLC sugar analysis.

Sucrose, glucose, fructose, leucrose and relative oligosaccharide concentrations in each diluted filtrate were determined using an AGILENT 1200 (Agilent Technologies) HPLC equipped with a 150×7.80 mm PHENOMENEX REZEX RNM carbohydrate Na$^+$ 8% column PHENOMENX KRUDKATCHER 0.5-μm guard column. The column was operated at 80° C. with an isocratic flow-rate of 0.9 mL/min with 10 mM Na$_2$HPO$_4$/NaH$_2$PO$_4$ pH 6.7 (5 min per sample). Five μL of diluted sample was injected. Appropriate sucrose, glucose, fructose, and leucrose calibration curves were used to determine sugar concentrations. A mixture of purified gluco-oligosaccharides was used to determine oligomer concentration.

The profiles of reactions (~20 hours) as measured via the above methodology are provided in Table 3.

TABLE 3

Product Profiles of GTF 6855 (SEQ ID NO: 4) and Single Amino Acid-Substituted Variants thereof

| GTF | Sucrose (g/L)[d] | Leucrose (g/L)[d] | Glucose (g/L)[d] | Fructose (g/L)[d] | Oligomers (g/L)[d,e] | Alpha-1,3 Glucan[f] Yield[f] | Fructose Balance |
|---|---|---|---|---|---|---|---|
| Plate 1[a] | | | | | | | |
| 6855[b] | 1.6 | 21.1 | 6.3 | 28.9 | 9.1 | 31% | 97% |
| 6855[b] | 1.6 | 21.3 | 6.3 | 29.1 | 10.5 | 27% | 98% |
| 6855[b] | 1.6 | 21.2 | 6.3 | 29.3 | 10.0 | 29% | 98% |
| 6855[b] | 1.6 | 21.1 | 6.3 | 28.9 | 10.8 | 27% | 97% |
| V186A[c] | 1.6 | 21.3 | 6.4 | 28.8 | 10.7 | 27% | 97% |
| V186M | 1.6 | 21.4 | 6.4 | 28.7 | 10.6 | 27% | 97% |
| E194C | 1.6 | 21.2 | 6.3 | 29.0 | 9.4 | 30% | 98% |
| L434N | 1.9 | 22.7 | 7.1 | 28.4 | 12.7 | 18% | 99% |
| A472C | 31.0 | 2.6 | 2.5 | 23.8 | 4.6 | 38% | 99% |
| A472S | 5.3 | 2.8 | 13.9 | 36.5 | 9.1 | 31% | 97% |
| A510E | 8.5 | 5.4 | 5.5 | 34.5 | 5.6 | 53% | 100% |
| A510E | 1.9 | 6.5 | 5.6 | 36.7 | 6.1 | 58% | 98% |
| A510I | 4.3 | 6.8 | 5.4 | 35.2 | 5.4 | 57% | 98% |
| A510V | 1.7 | 9.5 | 6.4 | 35.6 | 6.8 | 51% | 99% |
| L513Y | 1.4 | 10.3 | 4.2 | 35.3 | 7.2 | 54% | 99% |
| M529L | 1.9 | 10.4 | 4.2 | 35.2 | 10.9 | 44% | 99% |
| K578M | 1.6 | 21.0 | 6.4 | 28.8 | 10.8 | 27% | 97% |
| Y605W | 6.1 | 8.0 | 2.6 | 33.3 | 5.4 | 59% | 97% |
| F607N | 8.4 | 11.4 | 4.1 | 30.5 | 7.1 | 45% | 98% |
| F607W | 9.1 | 4.6 | 3.8 | 33.9 | 8.6 | 49% | 98% |
| N613I | 4.5 | 7.7 | 6.4 | 35.8 | 14.8 | 29% | 101% |
| N613M | 2.7 | 11.0 | 5.3 | 34.6 | 12.1 | 37% | 100% |
| N613T | 1.7 | 10.3 | 4.6 | 35.0 | 7.1 | 53% | 98% |
| N613V | 2.8 | 0.0 | 6.3 | 37.3 | 12.1 | 48% | 92% |
| Q616E | 3.9 | 2.4 | 5.8 | 37.3 | 8.8 | 53% | 97% |
| K625A | 1.5 | 21.2 | 6.3 | 29.4 | 9.9 | 29% | 99% |
| K625M | 1.5 | 21.3 | 6.3 | 29.3 | 10.6 | 27% | 99% |
| S631T | 5.4 | 11.4 | 4.6 | 32.0 | 7.6 | 46% | 97% |
| T635H | 4.1 | 11.0 | 5.0 | 32.7 | 8.2 | 46% | 97% |
| T635W | 13.1 | 8.5 | 4.5 | 29.6 | 7.0 | 42% | 98% |
| I636H | 7.0 | 11.7 | 5.0 | 31.1 | 8.1 | 42% | 98% |
| D947G | 2.4 | 19.1 | 6.1 | 29.8 | 9.9 | 31% | 98% |
| F951Y | 4.0 | 1.5 | 9.9 | 38.0 | 15.4 | 28% | 97% |
| E849M | 1.4 | 20.7 | 6.2 | 29.5 | 10.4 | 29% | 98% |
| Q1007A | 1.4 | 19.4 | 6.2 | 30.2 | 10.1 | 31% | 98% |
| D1003G | 13.8 | 10.7 | 4.6 | 28.3 | 5.4 | 42% | 98% |
| A1022M | 1.7 | 20.6 | 6.2 | 29.3 | 12.2 | 24% | 98% |
| D1028L | 1.6 | 22.1 | 6.6 | 28.9 | 11.6 | 23% | 99% |
| D1028Q | 1.6 | 21.7 | 6.5 | 29.4 | 10.9 | 26% | 99% |
| A1057H | 1.5 | 21.4 | 6.4 | 29.2 | 10.6 | 27% | 98% |

TABLE 3-continued

Product Profiles of GTF 6855 (SEQ ID NO: 4) and Single Amino Acid-Substituted Variants thereof

| GTF | Sucrose (g/L)[d] | Leucrose (g/L)[d] | Glucose (g/L)[d] | Fructose (g/L)[d] | Oligomers (g/L)[d,e] | Alpha-1,3 Glucan[f] Yield[i] | Fructose Balance |
|---|---|---|---|---|---|---|---|
| N1096A | 1.6 | 22.4 | 6.6 | 28.6 | 10.7 | 25% | 98% |
| E1132A | 1.5 | 21.4 | 6.4 | 29.2 | 10.6 | 27% | 98% |
| E1132H | 1.5 | 21.3 | 6.4 | 29.2 | 10.5 | 27% | 98% |
| E1132K | 1.5 | 21.4 | 6.4 | 29.2 | 10.4 | 27% | 98% |
| E1132R | 1.5 | 21.6 | 6.4 | 29.1 | 10.8 | 26% | 99% |
| L1212N | 1.5 | 20.9 | 6.3 | 29.5 | 10.4 | 28% | 98% |
| T1431M | 1.5 | 21.4 | 6.3 | 29.4 | 10.5 | 27% | 99% |
| A1442R | 1.5 | 21.3 | 6.4 | 29.1 | 10.6 | 27% | 98% |
| Dead[g] | 79.4 | 0.0 | 0.0 | 0.0 | 0.0 | 0% | 100% |
| Blank[h] | 79.7 | 0.0 | 0.1 | 0.0 | 0.0 | 0% | 100% |
| Blank[h] | 80.1 | 0.0 | 0.0 | 0.0 | 0.0 | 0% | 100% |
| Plate 2[a] | | | | | | | |
| 6855[b] | 1.4 | 20.1 | 6.4 | 28.2 | 10.0 | 29% | 99% |
| 6855[b] | 1.4 | 20.1 | 6.4 | 28.2 | 10.1 | 28% | 99% |
| 6855[b] | 1.4 | 20.0 | 6.3 | 28.3 | 10.3 | 28% | 99% |
| 6855[b] | 1.5 | 20.2 | 6.3 | 28.2 | 10.0 | 29% | 100% |
| Y219C[c] | 1.5 | 20.6 | 6.5 | 27.7 | 10.7 | 25% | 99% |
| E243H | 1.4 | 20.3 | 6.3 | 28.2 | 10.1 | 28% | 100% |
| L373A | 2.4 | 11.3 | 11.2 | 27.4 | 21.6 | −7% | 87% |
| L373Q | 4.0 | 7.5 | 10.7 | 28.4 | 21.5 | −2% | 87% |
| L373V | 2.5 | 11.6 | 11.5 | 27.5 | 21.8 | −9% | 88% |
| A377I | 2.9 | 15.5 | 6.6 | 29.3 | 11.3 | 29% | 98% |
| D425Q | 1.8 | 15.3 | 5.3 | 30.3 | 9.6 | 39% | 99% |
| L428V | 5.3 | 10.5 | 6.2 | 30.8 | 8.2 | 42% | 98% |
| N475F | 6.1 | 26.8 | 20.5 | 24.9 | 7.2 | −16% | 106% |
| N475W | 1.5 | 61.8 | 7.5 | 9.1 | 1.9 | −8% | 106% |
| L513F | 1.0 | 10.9 | 4.6 | 33.3 | 7.1 | 55% | 99% |
| L513W | 1.3 | 11.5 | 4.9 | 32.4 | 8.9 | 48% | 98% |
| M529N | 3.5 | 11.6 | 4.8 | 31.6 | 7.6 | 49% | 99% |
| I608Y | 2.4 | 15.7 | 5.7 | 29.9 | 9.8 | 35% | 99% |
| N613G | 2.2 | 10.5 | 5.0 | 33.5 | 10.6 | 43% | 101% |
| N613L | 2.9 | 13.3 | 5.0 | 32.1 | 11.7 | 35% | 102% |
| D617E | 8.4 | 10.2 | 6.9 | 29.8 | 9.0 | 34% | 99% |
| E621T | 1.5 | 18.6 | 6.0 | 29.1 | 10.4 | 30% | 100% |
| I623H | 69.8 | 0.2 | 1.4 | 3.3 | 0.0 | 4% | 101% |
| I627W | 7.7 | 12.2 | 5.2 | 28.9 | 7.9 | 40% | 99% |
| S631D | 9.8 | 12.3 | 5.7 | 27.5 | 8.0 | 35% | 98% |
| S631E | 10.1 | 12.6 | 5.6 | 27.3 | 8.0 | 35% | 99% |
| S631R | 6.7 | 12.3 | 5.4 | 28.7 | 8.1 | 40% | 97% |
| G633W | 7.0 | 7.2 | 5.5 | 31.9 | 8.5 | 46% | 99% |
| F634A | 7.4 | 8.4 | 5.7 | 30.8 | 8.2 | 43% | 98% |
| T635E | 1.6 | 17.2 | 6.0 | 29.9 | 9.5 | 35% | 100% |
| T635I | 1.5 | 17.4 | 6.2 | 30.5 | 10.1 | 32% | 102% |
| T635Y | 13.8 | 8.0 | 4.6 | 28.0 | 6.7 | 43% | 99% |
| A510E | 2.5 | 5.9 | 5.5 | 34.8 | 4.3 | 66% | 99% |
| N904E | 5.7 | 6.9 | 12.6 | 32.5 | 13.5 | 15% | 98% |
| K930G | 1.4 | 19.8 | 6.2 | 28.4 | 10.0 | 30% | 99% |
| K930V | 1.4 | 19.6 | 6.3 | 28.6 | 10.0 | 30% | 100% |
| D947F | 1.4 | 20.3 | 6.2 | 27.8 | 9.9 | 29% | 99% |
| D947I | 1.4 | 19.9 | 6.3 | 28.6 | 10.7 | 27% | 100% |
| D947K | 1.4 | 19.9 | 6.2 | 28.6 | 9.7 | 30% | 100% |
| D947N | 1.4 | 20.5 | 6.3 | 27.9 | 10.0 | 28% | 99% |
| D947Q | 1.4 | 19.5 | 6.2 | 28.4 | 9.6 | 31% | 99% |
| D947S | 1.3 | 18.9 | 6.1 | 28.8 | 9.4 | 33% | 99% |
| D947V | 1.4 | 19.8 | 6.2 | 28.3 | 9.7 | 30% | 99% |
| D947Y | 1.4 | 20.7 | 6.3 | 28.1 | 10.0 | 28% | 100% |
| Q1007S | 1.3 | 18.3 | 6.1 | 29.1 | 9.6 | 33% | 99% |
| D1003N | 3.6 | 13.1 | 5.7 | 30.5 | 9.8 | 38% | 99% |
| I1026H | 1.4 | 19.4 | 6.2 | 28.7 | 9.7 | 31% | 100% |
| D1028A | 1.5 | 20.1 | 6.5 | 28.4 | 10.8 | 26% | 100% |
| D1028M | 1.5 | 20.4 | 6.6 | 28.1 | 11.1 | 24% | 100% |
| V1037A | 1.5 | 20.2 | 6.4 | 28.4 | 10.3 | 28% | 100% |
| K1041A | 4.3 | 19.6 | 6.5 | 27.0 | 10.7 | 23% | 99% |
| K1041M | 1.5 | 20.5 | 6.4 | 28.0 | 10.5 | 26% | 100% |
| D1080M | 1.4 | 20.0 | 6.4 | 28.3 | 10.1 | 29% | 99% |
| F1244P | 1.4 | 19.6 | 6.3 | 28.6 | 9.9 | 30% | 100% |
| F1244Q | 1.4 | 19.7 | 6.4 | 28.6 | 9.9 | 30% | 100% |
| T1431Q | 1.4 | 20.0 | 6.2 | 28.5 | 8.9 | 33% | 100% |
| G1484P | 1.5 | 20.1 | 6.3 | 28.5 | 9.2 | 31% | 100% |
| W1437N | 1.4 | 19.5 | 6.0 | 28.9 | 8.4 | 35% | 100% |
| Dead[g] | 75.5 | 0.0 | 0.0 | 0.0 | 0.0 | 0% | 100% |

TABLE 3-continued

Product Profiles of GTF 6855 (SEQ ID NO: 4) and Single Amino Acid-Substituted Variants thereof

| GTF | Sucrose (g/L)[d] | Leucrose (g/L)[d] | Glucose (g/L)[d] | Fructose (g/L)[d] | Oligomers (g/L)[d,e] | Alpha-1,3 Glucan[f] Yield[i] | Fructose Balance |
|---|---|---|---|---|---|---|---|
| Blank[h] | 75.5 | 0.0 | 0.0 | 0.0 | 0.0 | 0% | 100% |
| Blank[h] | 76.0 | 0.0 | 0.0 | 0.0 | 0.5 | −2% | 100% |

[a] Glucan synthesis reactions were run in microtiter plate format (two plates).
[b] GTF 6855, SEQ ID NO: 4. Reactions with this GTF were run in quadruplicate per plate.
[c] Each listed GTF with a substitution is a version of GTF 6855 comprising a substitution at a respective position, where the position number is in correspondence with the residue numbering of SEQ ID NO: 62. The wild type residue is listed first (before residue position number) and the substituting residue is listed second (after the residue position number) (this "wild type residue-position number-variant residue" annotation format applies throughout the present disclosure).
[d] Sucrose, leucrose, glucose, fructose and oligomers were measured as present in filtrate prepared post reaction.
[e] "Oligomers", gluco-oligosaccharides (believed to all or mostly be of DP ≤7 or 8).
[f] Insoluble alpha-1,3 glucan product.
[g] GTF with destroyed activity was entered into the reaction.
[h] No GTF was added to the reaction.
[i] Alpha-glucan yield based on glucosyl.

Based on the data in Table 3, it is apparent that certain single amino acid substitutions in GTF 6855 (SEQ ID NO:4) can increase this enzyme's yield of alpha-1,3-glucan and/or decrease its leucrose yield in glucan synthesis reactions, for example.

Example 2

Analysis of the Effects of Single Amino Acid Substitutions on Other Glucosyltransferases This Example describes the effects of certain single amino acid substitutions on the activities of glucosyltransferases other than GTF 6855 (SEQ ID NO:4). In general, it appears that substitutions corresponding to (or similar to) those observed in Example 1 having a significant effect on alpha-glucan and/or leucrose yields may be useful for imparting similar effects to different glucosyltransferases.

Phe-607-Tyr

Example 1 demonstrated, for example, that substitutions in GTF 6855 (SEQ ID NO:4) at the position corresponding to position 607 of SEQ ID NO:62 affected enzyme activity (Table 3). In particular, substitutions of the Phe residue with an Asn or Trp residue both had significant effects on alpha-1,3 glucan yield (increased) and leucrose yield (decreased) compared to the respective yields of the non-substituted enzyme.

To test whether a similar substitution could similarly affect yields in a different GTF, a substitution was made at a position in GTF 7527 (GTFJ, SEQ ID NO:65) corresponding to position 607 of SEQ ID NO:62, exchanging a Phe for a Tyr residue. GTF 7527 (SEQ ID NO:65) essentially is an N-terminally truncated (signal peptide and variable region removed) version of the full-length wild type glucosyltransferase (represented by SEQ ID NO:60) from *Streptococcus salivarius* (see Table 1). Substitutions made in SEQ ID NO:65 can be characterized as substituting for native amino acid residues, as each amino acid residue/position of SEQ ID NO:65 (apart from the Met-1 residue of SEQ ID NO:65) corresponds accordingly with an amino acid residue/position within SEQ ID NO:60. In reactions comprising at least sucrose and water, the glucosyltransferase of SEQ ID NO:65 typically produces alpha-glucan having about 100% alpha-1,3 linkages and a $DP_n$ of 400 or greater (e.g., refer to U.S. Patent Appl. Publ. No. 2017/0002335 [application Ser. No. 15/182,747], which is incorporated herein by reference).

Glucan synthesis reactions were prepared as follows using GTF 7527 (SEQ ID NO:65) or a version thereof comprising a Phe-to-Tyr substitution at the position corresponding to position 607 of SEQ ID NO:62: vessel, 250-mL indented shake flask agitated at 100 rpm; initial pH, 5.5; reaction volume, 50 mL; sucrose, 100.1 g/L; GTF, 100 U/L; KH$_2$PO4, 25 mM; temperature, 25° C.; time, 20 hours. The profiles of each reaction (as measured via methodology similar to that disclosed in Example 1), which were run in duplicate, are provided in Table 4.

TABLE 4

Product Profiles of GTF 7527 (SEQ ID NO: 65) and a Single Amino Acid-Substituted Variant thereof

| GTF | Sucrose Conv. | Yield Alpha-Glucan[d] based on Glucosyl | Leucrose Yield | Glucose Yield | Oligo-mer[c] Yield | Fructose balance |
|---|---|---|---|---|---|---|
| 7527[a] | 99.7% | 29.24% | 42% | 4.20% | 28% | 105.62% |
| 7527 | 99.8% | 22.21% | 43% | 6.26% | 29% | 109.02% |
| F607Y[b] | 99.8% | 64.92% | 16% | 3.33% | 15% | 102.73% |
| F607Y | 99.8% | 62.97% | 17% | 3.35% | 17% | 109.17% |

[a] GTF 7527, SEQ ID NO: 65.
[b] F607Y, version of GTF 7527 (SEQ ID NO: 65) comprising a Phe-to-Tyr substitution at the position corresponding to position 607 of SEQ ID NO: 62.
[c] "Oligomer", gluco-oligosaccharides (believed to all or mostly be of DP ≤7 or 8).
[d] "Alpha-Glucan", insoluble alpha-1,3 glucan.

Based on the data in Table 4, it is apparent that the F607Y substitution in GTF 7527 (SEQ ID NO:65) can increase this enzyme's yield of alpha-1,3-glucan and/or decrease its leucrose yield in glucan synthesis reactions, for example.

Ala-510-Glu, Ala-510-Val, or Ala-510-Cys

Example 1 demonstrated, for example, that substitutions in GTF 6855 (SEQ ID NO:4) at the position corresponding to position 510 of SEQ ID NO:62 affected enzyme activity (Table 3). In particular, substitutions of the Ala residue with a Glu, Ile, or Val residue all had significant effects on alpha-1,3 glucan yield (increased) and leucrose yield (decreased) compared to the respective yields of the non-substituted enzyme.

To test whether these or similar substitutions could similarly affect yields in different GTFs, substitutions were made at positions in GTFs 2919 (SEQ ID NO:28), 0427 (SEQ ID NO:26), 5926 (SEQ ID NO:14), 0874 (SEQ ID NO:2), 0544 (SEQ ID NO:12), 2379 (SEQ ID NO:6), 5618 (SEQ ID NO:18), 4297 (SEQ ID NO:16), 1366 (SEQ ID NO:24), and 6907 (SEQ ID NO:36) corresponding to position 510 of SEQ ID NO:62, exchanging an Ala for a Glu, Val, or Cys residue. Each of these GTFs essentially is an N-terminally truncated (signal peptide and variable region removed) version of a full-length wild type glucosyltransferase (e.g., refer to respective GENBANK annotation information, such as that listed in Table 1). Substitutions made in each of SEQ ID NOs:28, 26, 14, 2, 12, 6, 18, 16, 24 and 36 can be characterized as substituting for native amino acid residues, as each amino acid residue/position of these sequences (apart from the Met-1 residues of each) corresponds accordingly with an amino acid residue/position within each respective full-length wild type glucosyltransferase counterpart. Table 2 lists the alpha-glucan typically produced by each of SEQ ID NOs:28, 26, 14, 2, 12, 6, 18, 16, 24 and 36 in reactions comprising at least sucrose and water.

Preparation of GTF 2919 (SEQ ID NO:28), 0427 (SEQ ID NO:26), 5926 (SEQ ID NO:14), 0874 (SEQ ID NO:2), 0544 (SEQ ID NO:12), 2379 (SEQ ID NO:6), 5618 (SEQ ID NO:18), 4297 (SEQ ID NO:16), 1366 (SEQ ID NO:24), or 6907 (SEQ ID NO:36), or versions thereof comprising a substitution at the position corresponding to position 510 of SEQ ID NO:62 was performed as follows. Codon-optimized (for *E. coli*) sequences encoding each of these GTFs were individually cloned into a suitable plasmid for bacterial expression. Each construct was then transformed into *E. coli* BL21-Al (Invitrogen, Carlsbad, Calif.). Transformed strains were grown in 10 mL auto-induction medium (10 g/L Tryptone, 5 g/L Yeast Extract, 5 g/L NaCl, 50 mM $Na_2HPO_4$, 50 mM $KH_2PO_4$, 25 mM $(NH_4)_2SO_4$, 3 mM $MgSO_4$, 0.75% glycerol, 0.075% glucose, 0.05% arabinose) containing 100 mg/L ampicillin at 37° C. for 20 hours under 200 rpm agitation. The cells were harvested by centrifugation at 8000 rpm at 4° C. and resuspended in 1 mL of 20 mM sodium phosphate buffer pH 6.0 with CelLytic™ Express (Sigma, St. Louise, Mo.) according to the manufacturer's instructions. In addition, resuspended cells were subjected to no less than one freeze-thaw cycle to ensure cell lysis. Lysed cells were centrifuged for 10 minutes at 12,000 g at room temperature. Each resulting supernatant was analyzed by SDS-PAGE to confirm expression of the particular GTF enzyme being expressed. Each supernatant was kept on ice at 4° C. until enzyme activity could be determined (within 1 hour), and/or stored at −20° C.

Glucan synthesis reactions were prepared, and the products thereof analyzed, largely according to the disclosure of U.S. Pat. Appl. Publ. No. 2014/0087431, which is incorporated herein by reference. Each reaction was run for 24-30 hours. The profiles of each reaction are provided in Table 5.

TABLE 5

Product Profiles of Various GTFs and Single Amino Acid-Substituted Variants thereof

| GTF | Sucrose Conv. | Yield Alpha-Glucan based on Glucosyl | Leucrose Yield | Glucose Yield | Oligo-mer Yield | Fructose balance |
|---|---|---|---|---|---|---|
| 2919[a] | 92% | 20% | 28% | 15% | 37% | 90% |
| A510E[b] | 98% | 40% | 13% | 15% | 31% | 93% |
| A510V[b] | 97% | 45% | 15% | 15% | 26% | 84% |
| A510C[b] | 95% | 35% | 19% | 15% | 32% | 87% |
| 0427[a] | 96% | 15% | 33% | 11% | 41% | 97% |
| A510E[b] | 96% | 1.0% | 40% | 16% | 43% | 104% |
| A510V[b] | | | poor conversion | | | |

TABLE 5-continued

Product Profiles of Various GTFs and Single Amino Acid-Substituted Variants thereof

| GTF | Sucrose Conv. | Yield Alpha-Glucan based on Glucosyl | Leucrose Yield | Glucose Yield | Oligo-mer Yield | Fructose balance |
|---|---|---|---|---|---|---|
| A510C[b] | 96% | 9% | 30% | 12% | 50% | 97% |
| 5926[a] | 97% | 12% | 37% | 11% | 41% | 93% |
| A510E[b] | 96% | 12% | 40% | 14% | 34% | 94% |
| A510V[b] | 97% | 25% | 31% | 14% | 31% | 81% |
| A510C[b] | 97% | −1% | 35% | 14% | 52% | 97% |
| 0847[a] | 97% | 18% | 33% | 11% | 38% | 92% |
| A510E[b] | 98% | 11% | 35% | 14% | 40% | 95% |
| A510V[b] | 80% | 32% | 21% | 16% | 31% | 80% |
| A510C[b] | 97% | 10% | 33% | 13% | 44% | 97% |
| 0544[a] | 99% | 37% | 22% | 8% | 33% | 86% |
| A510E[b] | 93% | 46% | 21% | 8% | 25% | 85% |
| A510V[b] | | | poor conversion | | | |
| A510C[b] | 92% | 39% | 16% | 9% | 37% | 90% |
| 2379[a] | 95% | 4% | 30% | 18% | 48% | 92% |
| A510E[b] | 97% | −2% | 23% | 23% | 56% | 93% |
| A510V[b] | 94% | 5% | 20% | 23% | 52% | 82% |
| A510C[b] | 93% | −10% | 37% | 21% | 53% | 101% |
| 5618[a] | 99% | 80% | 10% | 5% | 5% | 89% |
| A510E[b] | 94% | 82% | 5% | 4% | 9% | 93% |
| A510V[b] | 99% | 83% | 7% | 5% | 5% | 78% |
| A5100[b] | 98% | 83% | 9% | 4% | 4% | 96% |
| 4297[a] | 97% | 78% | 12% | 6% | 4% | 86% |
| A510E[b] | 99% | 84% | 7% | 4% | 5% | 83% |
| A510V[b] | 99% | 78% | 8% | 8% | 6% | 77% |
| A510C[b] | 80% | 71% | 8% | 9% | 7% | 84% |
| 1366[a] | 97% | 12% | 39% | 7% | 43% | 91% |
| A510E[b] | 99% | 9% | 39% | 16% | 36% | 89% |
| A510V[b] | 78% | 17% | 28% | 16% | 39% | 80% |
| A510C[b] | 97% | 1% | 39% | 12% | 48% | 96% |
| 6907[a] | 85% | 7% | 42% | 17% | 34% | 91% |
| A510E[b] | 89% | 14% | 35% | 25% | 26% | 94% |
| A510V[b] | | | poor conversion | | | |
| A510C[b] | | | poor conversion | | | |

[a]GTF 2919 (SEQ ID NO: 28), 0427 (SEQ ID NO: 26), 5926 (SEQ ID NO: 14), 0874 (SEQ ID NO: 2), 0544 (SEQ ID NO: 12), 2379 (SEQ ID NO: 6), 5618 (SEQ ID NO: 18), 4297 (SEQ ID NO: 16), 1366 (SEQ ID NO: 24), or 6907 (SEQ ID NO: 36).
[b]A510E/V/C, version of listed GTF (footnote [a]) comprising a substitution with Glu, Val, or Cys at the position corresponding to position 510 of SEQ ID NO: 62.
[c]"Oligomer", gluco-oligosaccharides.

Based on the data in Table 5, it is apparent that some substitutions in various GTFs at the position corresponding to position 510 of SEQ ID NO:62 can increase a GTF's yield of alpha glucan and/or decrease its leucrose yield in glucan synthesis reactions, for example.

Phe-951-Tyr, Leu-373-Phe, or Leu-373-Met

Example 1 demonstrated, for example, that substitutions in GTF 6855 (SEQ ID NO:4) at the positions corresponding to positions 373 and 951 of SEQ ID NO:62 affected enzyme activity (Table 3). In particular, substitution of the Phe-951 residue with a Tyr residue had a significant effect on leucrose yield (decreased) compared to the respective yield of the non-substituted enzyme. Substitution of the Leu-373 residue with an Ala, Gln, or Val residue also had a significant lowering effect on leucrose yield.

To test whether similar substitutions could affect yields in different GTFs, a substitution was made at position 839 (exchanging a Phe for a Tyr) in GTF 5604 (SEQ ID NO:68) and at position 886 (exchanging a Phe for a Tyr) in GTF 8845 (SEQ ID NO:69, refer to proxy GTF below), each of which positions correspond to position 951 of SEQ ID NO:62. In other analyses, a substitution was made at position 316 (exchanging a Leu for a Phe or Met) in GTF 5604 (SEQ ID NO:68) and at position 363 (exchanging a Leu for a Phe or Met) in GTF 8845 (SEQ ID NO:69, refer to proxy GTF below), each of which positions correspond to position 373 of SEQ ID NO:62.

GTF 5604 (SEQ ID NO:68) is a full-length wild type glucosyltransferase (including a signal peptide at residues 1-36) from *Streptococcus criceti* (see Table 1); it was thus expected that the expressed enzyme in mature form had residues 37-1338 of SEQ ID NO:68. GTF 8845 (SEQ ID NO:69) is full-length wild type glucosyltransferase (including a signal peptide at residues 1-36) from *Streptococcus sobrinus* (see Table 1). A proxy for GTF 8845 was expressed herein in the form of SEQ ID NO:70, which represents an N-terminally truncated version of the full-length wild type glucosyltransferase fused to a *B. subtilis* AprE signal peptide (the above substitutions listed for GTF 8845 were actually tested in the context of the proxy GTF). In particular, residues 30-1414 of SEQ ID NO:70 represent residues 170-1554 of GTF 8845 (SEQ ID NO:69), whereas residues 1-29 of SEQ ID NO:70 represent heterologous amino acids including a signal peptide. The expressed proxy GTF in mature form was therefore expected to have residues 170-1554 of GTF 8845 (SEQ ID NO:69). In reactions comprising at least sucrose and water, the mature form of GTF 5604 (SEQ ID NO:68) is believed to produce oligosaccharides of DP8 and above (i.e., DP8+) (e.g., DP 18 or 19) having about 100% alpha-1,6 linkages (see Table 4 [sample SG1018] of WO2015/183714 or U.S. Patent Appl. Publ. No. 2017/0218093, which are incorporated herein by reference). In reactions comprising at least sucrose and water, a mature GTF having residues 170-1554 of GTF 8845 (SEQ ID NO:69) is believed to produce DP8+ oligosaccharides (e.g., DP 116 or 117) having about 80% alpha-1,6 linkages, 3% alpha-1,3 linkages and 17% alpha-1,3,6 linkages (see Table 4 [sample SG1051] of WO2015/183714).

Plasmids for expressing the foregoing GTFs and single amino acid-substituted variants thereof in *Bacillus* (protein secretion) were prepared accordingly. These plasmids were then individually transformed into *Bacillus subtilis* strain BG6006, and transformed clones were selected on tetracycline (12.5 µg/mL) plates. BG6006 is a nine protease deletion strain derived from the well-known *B. subtilis* type strain 168, and has the genotype: amyE::xylRPxylAcomK-ermC, degUHy32, oppA, DspoIIE3501, ΔaprE, ΔnprE, Δepr, ΔispA, Δbpr, Δvpr, ΔwprA, Δmpr-ybfJ, ΔnprB. Each transformed strain was grown up in LB medium containing 10 µg/mL tetracycline first, and then subcultured into Grants II medium containing 12.5 µg/mL tetracycline and grown at 37° C. for 2 days. The cultures were spun at 15,000 g for 30 min at 4° C. and the supernatants were filtered through 0.22-µm filters. The filtered supernatants from each culture were run on SDS-PAGE to confirm GTF expression. No obvious differences in expression levels were observed between the GTF variants and their respective non-variant parents.

Glucan synthesis reactions were prepared, and the products thereof analyzed, as follows. The *B. subtilis* supernatants prepared above containing an expressed GTF were used to set up reactions comprising sucrose as the substrate. Each reaction comprised 100 g/L sucrose, 10% (v/v) GTF supernatant, 10 mM sodium citrate buffer pH 5.0 and 1 mM CaCl$_2$, and was held at 37° C. for one or two days. Besides forming alpha-glucan product(s) (e.g., soluble gluco-oligosaccharides of DP3-8 or DP8+), each reaction also generated fructose co-product and leucrose by-product, for example. The reactions were filtered and analyzed by HPLC. BioRad AMINEX HPX-87C columns were used to analyze small sugars (mono- and di-saccharides). Two BioRad AMINEX HPX-87C columns (300 cm×7.8 mm) in series were placed in an external heater at 85° C. The standard cartridge holder (BioRad cat #125-0131) contained a MICROGUARD CARBO-C cartridge (BioRad cat #125-0128). The mobile phase was d.d. H$_2$O at a 0.6 mL/min flow rate. The injection volume was 10 µL. The RI detector was set at 410 at 40° C. The analysis time was 35 min for each sample. The BioRad AMINEX HPX-42A column was used to analyze oligosaccharides. The BioRad AMINEX HPX-42A column (300 cm×7.8 mm) was placed in an external heater at 85° C. The de-ashing cartridge holder (BioRad cat #125-0139) contained de-ashing refill cartridges (BioRad cat #125-0118). The mobile phase and detection was similar as for the HPX-87C columns. Table 6 below summarizes the HPLC analysis of the sugars and oligosaccharides in each GTF reaction. The data are the averages of four replicates of each reaction; each standard deviation was below 7%.

TABLE 6

Product Profiles of GTFs 5604, 8845, and Single Amino Acid-Substituted Variants thereof

| GTF | Sucrose (g/L) | Leucrose (g/L) | Glucose (g/L) | Fructose (g/L) | DP2 (g/L) | DP3-8 (g/L) | DP8+ est. (g/L) | Total Sugars (g/L) |
|---|---|---|---|---|---|---|---|---|
| 5604[a] | 0.2 | 10.6 | 4.7 | 36.6 | 3.3 | 1.0 | 39.8 | 96.2 |
| L373F[b] | 0.2 | 3.4 | 4.6 | 39.8 | 2.4 | 2.0 | 45.2 | 97.6 |
| L373M[b] | 0.3 | 7.1 | 4.9 | 38.2 | 2.7 | 1.4 | 43.3 | 97.8 |
| F951Y[b] | 0.5 | 1.1 | 4.9 | 40.7 | 3.4 | 2.7 | 45.1 | 98.2 |
| 8845[a] | 1.3 | 16.6 | 10.8 | 35.7 | 1.1 | 0.0 | 31.2 | 96.5 |
| L373F[b] | 1.5 | 16.6 | 13.3 | 35.3 | 1.9 | 1.5 | 28.4 | 87.9 |
| L373M[b] | 0.5 | 11.4 | 10.8 | 38.1 | 0.9 | 0.2 | 36.1 | 97.9 |
| F951Y[b] | 1.0 | 1.8 | 10.9 | 42.6 | 0.7 | 0.0 | 41.4 | 92.2 |

[a] GTF 5604 (secreted form having residues 37-1338 of SEQ ID NO: 68), GTF 8845 (secreted form having residues 170-1554 of SEQ ID NO: 69).
[b] Version of listed GTF (footnote [a]) comprising a single amino acid substitution, where the liste position number is in correspondence with the residue numbering of SEQ ID NO: 62.

As shown in Table 6, parent GTF 5604 produced about 10.6 g/L leucrose. In reactions using the L373F, L373M and F951Y variants of GTF 5604, leucrose was reduced to 3.4 g/L, 7.1 g/L, and 1.1 g/L respectively. Consistent with this decrease of leucrose by-product, each variant GTF reaction had an increase in both fructose co-product levels and estimated levels of DP8+ oligomers. These reaction profiles were generally mirrored by GTF 8845 and its variants, except for the L373F variant.

The linkage profiles of the reaction products listed in Table 6 were analyzed by GC/MS. No significant differences in linkages were observed between the products of the non-variant GTF parents and the products of their respective single amino acid-substituted variants.

In summary, based on the data in Table 6, it is apparent that some substitutions in various GTFs at positions corresponding to positions 373 or 951 of SEQ ID NO:62 can increase a GTF's yield of alpha glucan and/or decrease its leucrose yield in glucan synthesis reactions, for example.

Example 3

Analysis of the Effects of Two or More Amino Acid Substitutions on Glucosyltransferase Selectivity Toward Alpha-Glucan Synthesis This Example describes the effects of introducing multiple amino acid substitutions to a glucosyltransferase and determining their effect on enzyme selectivity toward alpha-glucan synthesis.

Briefly, certain amino acid substitutions were made to SEQ ID NO:4 (GTF 6855, see Table 1 and Example 1 for description of this glucosyltransferase). These substitutions are listed in Table 7 below. Each variant enzyme was entered into a glucan synthesis reaction with parameters that were the same as, or similar to, the following: vessel, 250-mL indented shake flask agitated at 120 rpm; initial pH, 5.7; reaction volume, 50 mL; sucrose, 75 g/L; GTF, 1.5 mL lysate of E. coli cells heterologously expressing enzyme; KH$_2$PO$_4$, 20 mM; temperature, 30° C.; time, about 20-24 hours. The alpha-1,3 glucan yield of each reaction (as measured via methodology similar to that disclosed in Example 1) is provided in Table 7.

TABLE 7

Alpha-1,3 Glucan Yields of GTF 6855 (SEQ ID NO: 4) Variants with Multiple Amino Acid-Substitutions

| GTF[a] | Alpha-1,3 Glucan[b] Yield[c] |
|---|---|
| A510D/F607Y/R741S | 72.6% |
| A510D/F607Y/N743S | 79.2% |
| A510D/F607Y/D948G | 88.2% |
| A510D/R741S/D948G | 74.5% |
| A510D/F607Y/R741S/D948G | 82.8% |
| A510E/F607Y/R741S/R1172C | 78.2% |
| A510D/F607Y/D820G/D948G | 87.8% |
| A510D/F607Y/D948G/R1172C | 88.6% |
| A510D/F607Y/N743S/D948G/R1172C | 89.4% |
| A510D/F607Y/R741S/L784Q/F929L/R1172C | 79.3% |

[a]Each listed GTF is a version of GTF 6855 (SEQ ID NO: 4) comprising substitutions at respective positions, where each position number is in correspondence with the residue numbering of SEQ ID NO: 62.
[b]Insoluble alpha-1,3 glucan product.
[c]Alpha-1,3-glucan yield based on glucosyl.

Based on the data in Table 7, it is apparent that introduction of multiple amino acid substitutions to GTF 6855 (SEQ ID NO:4) can increase this enzyme's yield of alpha-1,3-glucan; for example, compare these yields to those of GTF 6855 (SEQ ID NO:4) without substitutions shown in Table 3. Each of the variant GTF enzymes listed in Table 7 also exhibited significant reductions in yields of leucrose, glucose and gluco-oligomers (data not shown).

It is apparent, for example, that a GTF with multiple substitutions such as at positions corresponding to positions 510 and/or 607 of SEQ ID NO:62 can increase a GTF's yield of alpha glucan.

SEQUENCE LISTING (71 sequences)

SEQ ID NO: 1 - DNA, 4308 bp, Streptococcus sobrinus
atggttgacggcaaatactactattatgatcaggacggtaacgtaaagaagaatttcgcggtgagcgttggtgacaaaatctactacttcgatgaaactggtgcatataaggataccagcaaagtggacgccgacaagagcagcagcgcggttagccaaaacgcgaccatctttgcggcgaataaccgtgcgtacagcacctctgcaaagaattttgaagcggtggataactacctgaccgcagacagctggtatcgtccgaaatccatcctgaaggacggcaaaacctggaccgagagcggtaaggatgatttccgtccactgctgatggcatggtggcctgacaccgaaactaagcgcaactacgtgaactatatgaataaagtggtcggtattgacaagacgtacactgcggaaacgtcgcaagcggatttgaccgcagcggcggagctggttcaagcgcgtatcgagcagaagattaccagcgaaaacaacaccaaatggctgcgcgaagcaatctccgcgttcgttaagacgcagcctcagtggaacggcgagtccgaaaagccgtatgacgatcacttgcagaacggtgcgctgctgtttgataaccaaaccgacctgacgccagacacccaaagcaattaccgtttgctgaaccgtaccccgaccaatcagactggtagcctggatagccgttttacgtataatccgaatgacccgttgggcggctacgatttcttgctggcgaacgacgttgacaatagcaatccggtcgtccaggctgaacagttgaactggctgcattatctgctgaactttggctctatttacgctaacgatgccgacgccaattttgacagcattcgcgttgatgccgtcgataatgtcgatgctgatctgctgcaaatcagcagcgattacctgaaagcagcgtatggcatcgacaagaataacaagaatgcgaacaaccatgttagcatcgtcgaagcgtggagcgacaatgataccccgtatttgcacgacgatggcgataatctgatgaacatggacaacaaatttcgcctgtccatgctgtggagcctggcaaagccgctggacaaacgtagcggtttgaacccgctgattcacaatagcctggtggaccgcgaggtggacgatcgtgaagtggaaaccgtgccgtcctacagctttgctcgtgcacatgatagcgaggtgcaggacatcatccgtgacattatcaaggctgagattaacccaaatagctttggttatagcttcactcaagaagagatcgagcaagcctttaagatttacaacgaggatttgaagaaaacggacaagaaatacacccactacaatgtgccgctgagctacaccctgctgctgaccaacaagggcagcatcccgcgtgtgtactatggtgatatgttcaccgatgatggccaatacatggcaaacaagaccgtcaactacgacgcaatcgagagcctgctgaaagcccgtatgaaatatgtcagcggtggccaagcaatgcagaactatcaaattggtaatggcgagattttgaccagcgtgcgctatggtaaaggtgccctgaagcagagcgataagggtgacgcgacgacgcgcactagcggtgttggcgtggttatgggtaatcagccgaacttctccctggacggtaaagttgtggccctgaatatgggtgcggcccatgcgaatcaagaataccgtgcactgatggtcagcactaaagacggtgtggcaacttacgcaaccgatgctgacgcatccaaagcgggcctggtcaagcgtaccgacgagaacggctacctgtacttcctgaatgatgatctgaagggcgtcgcgaaccctcaggtttccggcttcttgcaagtgtgggttccagttggtgccgccgatgaccaggacattcgcgtcgccgccagcgacacggcgagcacggatggtaaaagcctgcatcaagatgcggcgatggacagccgcgtcatgtttgagggtttcagcaattttcaatccttcgcgaccaaagaagaagaatacacgaatgttgttatcgcgaacaatgtcgataagttcgttagctggggtatcaccgattttgaaatggctccgcagtatgttagcagcaccgacggtcagttcttggacagcgtcatccagaatggctatgcgtttactgatcgctatgatctgggtatgtccaaggcgaacaagtatggcacggcagaccaactggttaaggcaatcaaagccctgcacgctaaaggcctgaaagttatggcggactgggtcccggatcaaatgtacacctttccaaaacaggaagttgtgaccgttacccgcaccgacaaattcggtaaaccgatcgccggctctcaaatcaatcacagcttgtatgtgaccgacaccaaatccagcggcgacgactaccaagcgaagtacggcggtgccttcctggatgaactgaaagaaaagtacccggaactgttcacgaaaaagcaaattagcacgggccaagcgattgatccgagcgtgaaaatcaagcagtggagcgcaaaatacttcaatggttcgaatatcctgggtcgcggtgcggactatgtgctgagcgaccaggtcagcaataagtatttcaacgtggcgagcgacaccttgttcctgccgtccagcctgctgggcaaggtcgtggagagcggcattcgttacgacggcaagggttacatctacaacagctccgcgaccggcgatcaggtcaaagcgtctttcattacggaagccggtaacctgtattacttcggcaaagacggttacatggttactggtgcccagacgattaatggcgccaactacttcttcctggaaaacggtacggcactgcgtaatacgatttacaccgatgctcaaggtaatagccactattacgcgaatgatggcaaacgctatgaaaatggctatcaacagttcggtaacgattggcgctactttaaagatggtaacatggcagtcggcctgaccacggttgatggcaacgtgcaatactttgacaaagacggcgtccaggcaaaggataagattatcgtcacccgtgatggcaaggtccgttacttcgatcagcacaacggtaacgcggcgaccaacacgttcattgctgataaaactggccattggtattacctgggtaaagatggcgtcgcggtgactggcgcccagaccgtcggcaaacaaaaactgtacttcgaggccaacggtcaacaagttaaaggtgactttgttacgtccgatgagggcaaactgtatttctatgacgttgattctggtgacatgtggacggacaccttcatcgaggataaggcgggcaactggttctatttgggcaaggatggtgcggcagttacgggtgcccaaacgattcgcggtcagaagctgtacttcaaggccaatggtcaacaggtcaagggtgacattgttaagggcaccgacggtaaaatccgctactatgatgcaaaatccggtgaacaggtgttcaacaaaacggtgaaagctgcggatggcaaaacgtatgttatcggtaatgatggtgtcgcggtggaccctagcgtggttaaaggtcaaacctttaaggacgcttcgggcgctctgcgtttctacaacttgaagggtcaactggtcactggcagcggctggtatgaaaccgcgaaccatgactgggtttacattcagtccggcaaggcactgaccggcgaacagaccattaacggtcaacacctgtatttcaaagaagatggtcaccaagtcaagggtcagttggtcacgggcaccgatggtaaagtgcgttactatgacgccaacagcggtgaccaagcattcaacaagagcgtcactgtgaatggtaaaacctattactttggcaacgatggtacggcgcagactgctggcaacccgaagggtcagacgttcaaggatggctccgacatccgtttttactctatggaaggccaactggtgaccggctcgggttggtacgagaacgcgcaaggccagtggctgtatgtgaaaaacggtaaggtgctgactggtctgcaaaccgttggcagccagcgtgtttacttcgacgagaatggtattcaggccaagggcaaagcagtgcgtaccagcgatggcaaaattcgttatttcgacgaaaacagcggcagcatgatcacgaatcaatggaagttcgtctatggtcagtattactactttggtaacgacggtgcacgtatttaccgtggttggaactaa

SEQ ID NO: 2 - protein, 1435 aa, Streptococcus sobrinus
MVDGKYYYYDQDGNVKKNFAVSVGDKIYYFDETGAYKDTSKVDADKSSSAVSQNATIFAANNRAYSTSAKNFEAVDNYLTADSWYRPKSILKDGKTWTESGKDDFRPLLMAWWPDTETKRNYVNYMNKVVGIDKTYTAETSQADLTAAAELVQARIEQKITSENNTKWLREAISAFVKTQPQWNGESEKPYDDHLQNGALLFDNQTDLTPDTQSNYRLLNRTPTNQTGSLDSRFTYNPNDPLGGYDFLLANDVDNSNPVVQAEQLNWLHYLLNFGSIYANDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDIIRDIIKAEINPNSFGYSFTQEEIEQAFKIYNEDLKKTDKKYTHYNVPLSYTLLLTNKGSIPRVYYGDMFTDDGQYMANKTVNYDAIESLLKARMKYVSGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQVSNKYFNVASDTLFLPSSLLGKVVESGIRYDGKGYIYNSSATGDQVKASFITEAGNLYYFGKDGYMVTGAQTINGANYFFLENGTALRNTIYTDAQGNSHYYANDGKRYENGYQQFGNDWRYFKDGNMAVGLTTVDGNVQYFDKDGVQAKDKIIVTRDGKVRYFDQHNGNAATNTFIADKTGHWYYLGKDGVAVTGAQTVGKQKLYFEANGQQVKGDFVTSDEGKLYFYDVDSGDMWTDTFIEDKAGNWFYLGKDGAAVTGAQTIRGQKLYFKANGQQVKGDIVKGTDGKIRYYDAKSGEQVFNKTVKAADGKTYVIGNDGVAVDPSVVKGQTFKDASGALRFYNLKGQLVTGSGWYETANHDWVYIQSGKALTGEQTINGQHLYFKEDGHQVKGQLVTGTDGKVRYYDANSGDQAFNKSVTVNGKTYYFGNDGTAQTAGNPKGQTFKDGSDIRFYSMEGQLVTGSGWYENAQGQWLYVKNGKVLTGLQTVGSQRVYFDENGIQAKGKAVRTSDGKIRYFDENSGSMITNQWKFVYGQYYYFGNDGARIYRGWN

SEQ ID NO: 3 - DNA, 4026 bp, Streptococcus salivarius SK126
atgatcgacggcaaatactattatgttaatgaggacggtagccacaaagaaaactttgcgattacggttaatggtcaactgctgtatttcggtaaggacggcgcactgacctctagcagcacttacagctttaccccaggtacgacgaacatcgtggatggcttttctatcaacaaccgcgcgtatgactccagcgaagcgtcctttgaactgattgatggctacttgactgccgactcctggtatcgtccggcttccatcatcaaggacggtgtcacgtggcaggccagcaccgcagaggactttcgcccgctgctgatggcgtggtggccaaacgtggatacccaggtgaactatctgaactacatgtctaaagtgtttaacctggacgcaaagtatagcagcaccgataaacaagagactctgaaggttgcagctaaggatattcagattaagatcgagcagaaaattcaggcggagaaaagcacccaatggctgcgcgaaacgatcagcgcttttgtgaaaacccaaccacagtggaacaaagagactgagaattactcgaaaggtggtggtgaggatcatctgcaaggcggtgcactgctgtacgtgaatgatagccgtaccccgtgggcaaatagcgattatcgccgcctgaaccgcaccgctaccaatcaaacgggtacgattgacaagtccattctggacgagcagagcgacccaaatcacatgggcggtttcgacttcctgctggcgaatgatgttgacctgtccaacccggttgtgcaggcagagcagctgaaccagattcactacttgatgaattggggctctatcgtgatgggtgacaaagacgcaaactttgatggtatccgtgtcgatgcagttgacaacgtcgatgccgacatgctgcaactgtataccaactacttccgtgaatactacggtgttaacaaaagcgaagcgaacgcactggcgcacattagcgttttggaagcgtggagcttgaatgataatcactacaacgacaaaaccgatggtgcagcattggcgatggagaataagcagcgtctggcgctgctgtttagcctggctaaaccgattaaagagcgcaccccggcagtgagcccgctgtataacaacaccttcaatacgacccaacgcgatgagaaaaccgactggatcaataaagacggttctaaggcctataacgaggatggtactgtgaagcagagcaccattggtaagtacaatgaaaaatatggtgatgcatcgggcaattatgtgttcatccgtgcccatgataacaatgtccaagacatcattgcggagatcattaagaaagaaatcaacccgaaaagcgatggtttcaccatcactgacgccgaaatgaaacaagcgttcgagatttacaataaggacatgctgagcagcgacaagaagtacaccctgaataacatcccggcagcttatgccgtgatgttgcagaacatggaaacgattacccgtgtctattatggtgacctgtacaccgacgacggccactacatggaaaccaagtccccgtattacgacaccatcgttaacctgatgaaaagccgtatcaagtacgtcagcggtggccaggcccaacgtagctactggctgccgaccgacggcaagatggacaatagcgacgttgagctgtatcgcaccaacgaagtgtataccagcgtccgttacggtaaagacattatgaccgcgaacgataccgagggtagcaagtacagccgcaccagcggccaggtcaccctggttgcaaacaacccgaagctgaccctggaccagagcgcgaagctgaatgtggaaatgggtaagattcacgcgaatcagaaataccgtgccctgattgtgggcacggctgacggtatcaagaatttcaccagcgacgcagatgctatcgcggcaggctacgtgaaagaaaccgactccaatggcgttctgacttttggcgctaatgacatcaaaggttatgaaaccttcgacatgtccggctttgttgctgtttgggtgccggtcggcgcgagcgatgatcaggacattcgtgtcgctcctagcactgaggccaagaaagagggtgaattgaccctgaaagcgaccgaagcatacgattcccagctgatctatgaaggttttagcaattttcaaaccatcccggatggtagcgacccgagcgtgtacaccaatcgcaagatcgcagagaacgtggacctgttcaagtcctggggtgttacctcgtttgaaatggcaccgcagttcgtttccgcagatgatggcacttttctggactctgtgatccaaaacggctatgcgtttgccgatcgttacgatttggcgatgagcaagaacaacaaatacggcagcaaagaggacttgcgtgacgcgctgaaagccctgcataaagcaggcatccaggcgattgcagactgggtcccggaccagatttatcagttgccgggcaaagaagtggtcacggcgactcgcaccgacggcgcaggccgtaaaatcgcggacgcgatcattgatcatagcctgtacgttgcgaacactaagagcagcggcaaagattaccaggcgaagtacggtggtgagttcttggcggagctgaaggccaagtacccggagatgttcaaagtgaacatgatttctaccggcaaaccgattgatgacagcgtcaaactgaaacagtggaaagcagaatactttaacggcaccaacgtcttggagcgcggtgtgggttatgtcctgagcgatgaagccacgggtaaatactttaccgtcacgaaggatggcaacttcattccgttgcagctgacgggtaatgagaaagtcgtgaccggctttagcaatgatggcaaaggtatcacctacttcggtacgagcggcactcaagcgaaatctgcgttcgttacgttcaatggtaatacttactattttgacgctcgtggtcacatggttacgaacggcgagtattcgccgaacggtaaggatgtttaccgtttcctgccgaatggtattatgctgtctaacgctttttacgttgatgcaaatggtaacacgtacctgtacaacagcaagggccaaatgtacaaaggcggttacaccaaatttgacgttaccgaaacggacaaagatggtaaggaaagcaaggtggtgaagtttcgttactttacgaacgaaggtgtcatggcaaaaggcgttaccgtgattgacggcttcacgcaatactttggtgaagatggtttccaagcgaaagacaagctggtcacgttcaagggcaagacgtactacttcgatgcacacaccggcaatgcgatcaaggacacctggcgtaatatcaatggcaagtggtatcatttcgacgcgaacggcgttgcagcgaccggcgctcaggtcatcaatggccaaaaactgtatttcaacgaggacggcagccaagtgaaaggcggtgttgtcaaaaacgcggacggtacgtattctaaatacaaagagggttctggtgaactggttaccaacgagttcttcacgacggatggcaatgtttggtactacgcaggcgcgaatggcaagaccgttacgggtgcccaggtgattaacggccaacacctgtacttcaatgcggacggttcgcaagtgaagggcggtgtggtcaagaacgcggatggcacctatagcaaatatgatgcgtctaccggcgaacgcctgaccaatgagtttttcaccacgggtgataacaactggtactacattggcgcaaacggcaagagcgtgacgggcgaggtcaagatcggtgacgatacctatttctttgccaaagatggcaagcaagttaagggtcaaactgtcagcgcgggtaacggtcgtattagctactactatggtgatagcggtaagcgtgcggtgagcacttggatcgaaatccaaccgggtgtttatgtctacttcgacaagaacggcattgcctatccgcctcgtgtgctgaattaa

SEQ ID NO: 4 - protein, 1341 aa, Streptococcus salivarius SK126 [sequence omitted]

SEQ ID NO: 5 - DNA, 3744 bp, Streptococcus salivarius
atgccaagccacattaagaccatcaacggcaaacaatactacgtggaggatgacggtacgattcgcaagaattacgtcctggagcgtatcggtggcagccaatactttaatgcagaaaccggtgaactgtctaatcagaaagagtatcgtttcgacaaaaatggtggtactggtagcagcgcggacagcacgaacaccaacgtgactgtgaacggtgacaaaaacgcattttacggtaccacggacaaagacattgagctggtcgacggctatttcaccgcgaacacctggtatcgcccgaaagaaatcctgaaagacggcaaagaatggaccgccagcacggagaacgataaacgcccgctgctgaccgtctggtggcctagcaaagcaatccaggcgtcttatctgaactacatgaaagagcaaggcctgggtaccaaccaaacgtacacgagcttctccagccaaacccaaatggatcaagcagccctggaagtgcaaaagcgtattgaagagcgcatcgcacgcgagggcaataccgactggctgcgcacgaccatcaagaacttcgtgaaaacccaaccgggttggaacagcacctctgaaaatctggacaataatgatcatctgcaaggtggcgccctgctgtacaataacgactcccgcacgagccacgcgaacagcgactatcgcctgctgaatcgtacgccgaccagccagaccggcaaacacaatccgaaatacaccaaagataccagcaatggtggtttcgaatttctgctggcgaacgacatcgataactctaatccggcggttcaagcagagcaactgaactggctgcattacattatgaacatcggtaccatcacgggcggttctgaggatgaaaacttcgacggcgttcgtgttgacgctgtggataatgtgaatgcggatctgctgcaaatcgcgagcgactatttcaaagcaaaatacggtgctgatcaaagccaagatcaggcgatcaaacacttgagcatcctggaagcgtggtcccataacgacgcctactataacgaagataccaaaggcgcgcagttgccgatggatgatccgatgcacctggctctggtctactcgctgctgcgtccgatcggcaatcgcagcggtgtggaaccgctgatttccaacagcctgaatgaccgtagcgagtccggtaagaacagcaaacgtatggcgaactacgcgttcgtacgcgcgcatgatagcgaggtgcaatcgattattggccagatcatcaaaaacgagatcaatccgcaaagcaccggtaatacgttcaccctggatgagatgaagaaagcgtttgagatttacaacaaggatatgcgtagcgcgaataagcagtatacgcagtacaacatcccgagcgcgtatgcgttgatgctgacccacaaggataccgttccgcgtgtgtattacggtgatatgtatacggacgacggtcagtacatggcgcaaaagagcccatactatgatgcgatcgaaacgctgctgaaaggtcgcatccgctatgccgcaggtggtcaggacatgaaggtcaactatattggttacggtaacactaacggctgggatgctgcgggcgtgctgaccagcgtacgttatggcacgggcgcaaatagcgccagcgatacgggtaccgccgaaacgcgtaatcaaggtatggcagtgattgttagcaaccaaccggcgctgcgtctgactagcaatttgaccattaacatgggtgccgcacaccgtaatcaggcttaccgtccgctgctgctgacgaccaacgatggcgtcgcgacctatttgaacgatagcgatgcgaatggtatcgttaagtacaccgacggtaatggtaatctgaccttctccgcaaacgagattcgtggcatccgtaacccgcaagttgatggctatctggccgtctgggttccggtaggtgcgtcggagaatcaggatgttcgtgtggcgccgagcaaagagaagaacagctccggtctggtttacgagagcaatgctgccctggatagccaagttatctacgaaggcttcagcaacttccaggacttcgttcagaatccgagccagtataccaacaaaaagattgcagagaatgcaaatttgttcaaatcctggggtattaccagctttgaatttgcgccgcagtacgtgagctcggatgatggtagcttcctggacagcgttattcagaacggttatgcgtttacggaccgctacgacattggtatgagcaaagacaacaaatatggttcgctggcggatttgaaggcagcactgaagagcttgcatgccgttggtattagcgcaatcgcggattgggttcctgatcagatctacaatctgccaggcgacgaggtcgtcaccgcaacccgcgttaacaactacggcgaaaccaaagatggtgcaatcattgatcactctttgtacgcggccaaaacccgtacttttggtaacgactaccagggtaagtatggtggtgcgttcctggacgagctgaaacgtctgtatccgcagatctttgaccgcgttcagatttctaccggtaagcgcatgaccacggacgagaagatcacccaatggtctgcaaagtatatgaacggtacgaacatcttggaccgtggctctgaatacgttttgaagaatggtctgaatggttactatggcaccaatggtggcaaagtttcgctgccgaaagttgtgggtagcaatcaaagcacgaatggcgacaatcaaaacggcgacggtagcggcaagtttgaaaagcgtctgttcagcgtgcgttaccgttataacaatggccagtacgcgaaaaatgcctttatcaaagataacgacggcaatgtttactatttcgacaatagcggtcgtatggctgtcggtgagaaaacgattgacggcaagcagtacttcttcctggctaatggcgttcagctgcgtgacggctaccgtcaaaatcgtcgcggtcaggtgttttactacgaccagaatggtgtgctgaacgcaaacggtaaacaagacccgaagcctgacaacaataacaatgcgagcggccgtaatcaattcgtccagatcggtaacaacgtgtgggcgtattatgatggcaatggtaaacgtgtcaccggtcaccagaacatcaacggtcaggagttgtttttcgataacaacggtgtccaggttaagggtcgtacggtgaatgagaacggtgcaattcgctactatgacgcgaatagcggtgagatggcacgcaatcgtttcgcggagattgaaccgggcgtctgggcatactttaacaatgacggcaccgcagtgaagggttctcagaatatcaatggtcaagacctgtacttcgaccagaacggtcgtcaggtcaagggtgcgctggccaatgttgatggcaacctgcgctattacgacgttaacagcggtgagctgtaccgtaatcgtttccacgaaatcgacggcagctggtattactttgatggtaacggtaatgcggtgaagggtatggtcaatatcaacggccaaaatctgttgtttgacaataacggcaaacagattaagggtcatctggtccgcgtcaacggcgtcgtgcgctattttgatccgaactctggtgaaatggcggttaatcgttgggttgaggtgagcccaggttggtgggtttactttgacggtgaaggtcgtggtcagatctaa

SEQ ID NO: 6 - protein, 1247 aa, Streptococcus salivarius
MPSHIKTINGKQYYVEDDGTIRKNYVLERIGGSQYFNAETGELSNQKEYRFDKNGGTGSSADSTNTNVTVNGDKNAFYGTTDKDIELVDGYFTANTWYRPKEILKDGKEWTASTENDKRPLLTVWWPSKAIQASYLNYMKEQGLGTNQTYTSFSSQTQMDQAALEVQKRIEERIAREGNTDWLRTTIKNFVKTQPGWNSTSENLDNNDHLQGGALLYNNDSRTSHANSDYRLLNRTPTSQTGKHNPKYTKDTSNGGFEFLLANDIDNSNPAVQAEQLNWLHYIMNIGTITGGSEDENFDGVRVDAVDNVNADLLQIASDYFKAKYGADQSQDQAIKHLSILEAWSHNDAYYNEDTKGAQLPMDDPMHLALVYSLLRPIGNRSGVEPLISNSLNDRSESGKNSKRMANYAFVRAHDSEVQSIIGQIIKNEINPQSTGNTFTLDEMKKAFEIYNKDMRSANKQYTQYNIPSAYALMLTHKDTVPRVYYGDMYTDDGQYMAQKSPYYDAIETLLKGRIRYAAGGQDMKVNYIGYGNTNGWDAAGVLTSVRYGTGANSASDTGTAETRNQGMAVIVSNQPALRLTSNLTINMGAAHRNQAYRPLLLTTNDGVATYLNDSDANGIVKYTDGNGNLTFSANEIRGIRNPQVDGYLAVWVPVGASENQDVRVAPSKEKNSSGLVYESNAALDSQVIYEGFSNFQDFVQNPSQYTNKKIAENANLFKSWGITSFEFAPQYVSSDDGSFLDSVIQNGYAFTDRYDIGMSKDNKYGSLADLKAALKSLHAVGISAIADWVPDQIYNLPGDEVVTATRVNNYGETKDGAIIDHSLYAAKTRTFGNDYQGKYGGAFLDELKRLYPQIFDRVQISTGKRMTTDEKITQWSAKYMNGTNILDRGSEYVLKNGLNGYYGTNGGKVSLPKVVGSNQSTNGDNQNGDGSGKFEKRLFSVRYRYNNGQYAKNAFIKDNDGNVYYFDNSGRMAVGEKTIDGKQYFFLANGVQLRDGYRQNRRGQVFYYDQNGVLNANGKQDPKPDNNNNASGRNQFVQIGNNVWAYYDGNGKRVTGHQNINGQELFFDNNGVQVKGRTVNENGAIRYYDANSGEMARNRFAEIEPGVWAYFNNDGTAVKGSQNINGQDLYFDQNGRQVKGALANVDGNLRYYDVNSGELYRNRFHEIDGSWYYFDGNGNAVKGMVNINGQNLLFDNNGKQIKGHLVRVNGVVRYFDPNSGEMAVNRWVEVSPGWWVYFDGEGRGQI

SEQ ID NO: 7 - DNA, 4434 bp, Streptococcus salivarius
atggacgaaacgcaggataagaccgtgacgcagagcaacagcggcaccaccgcttccctggtcactagccctgaagccacgaaagaggcggacaaacgcacgaacactaaagaggccgacgttctgacgcctgcaaaagaaacgaacgcagtcgagactgcgaccaccactaacacccaggcgacggcggaggccgccacgaccgcgaccaccgcggacgtcgcggtggctgcggtgccgaacaaagaagcggtcgttaccacggatgctccggcggtcacgaccgagaaagcggaagaacagccggctaccgttaaagcagaagtcgtcaatacggaagtgaaagcgccggaagcggctctgaaagacagcgaggttgaggcagcgctgagcctgaagaacatcaagaacattgatggcaagtattactatgttaatgaggatggcagccacaaagagaatttcgctattaccgtgaatggccagctgctgtactttggtaaagacggtgcgctgacgtcctctagcacgtattcttttaccccaggcactaccaatatcgtggacggttttagcattaacaaccgcgcttacgacagcagcgaggcgagctttgagctgatcgacggttacttgaccgcagacagctggtatcgtccggctagcatcatcaaagatggtgttacgtggcaagcgtccaccgccgaggattttcgtccgctgctgatggcatggtggccgaatgtggatacgcaggtgaactatttgaattacatgtccaaagttttcaacctggacgcgaaatactctagcaccgacaaacaggaaaccctgaaagtggcagcaaaagacattcaaatcaagattgaacaaaagattcaagcggagaagagcacgcagtggctgcgtgaaactatcagcgcctttgtgaaaacccagccgcagtggaacaaagaaaccgagaattacagcaagggtggtggtgaggaccacctgcaaggtggcgcactgctgtatgttaacgacagccgtaccccttgggcgaatagcgattaccgtcgtctgaatcgcaccgcaaccaatcagacgggcacgatcgataagtctattctggacgagcagtctgacccaaaccacatgggcggtttcgactttctgctggcgaacgacgtcgacctgagcaatccggtcgtgcaggctgagcagctgaatcaaatccactatctgatgaattggggttccattgtgatgggtgacaaggatgcgaactttgacggcattcgtgtcgatgcagttgacaacgtggacgcggacatgttgcaactgtataccaattacttccgtgagtactacggtgtgaacaagagcgaagctaacgcactggctcacatcagcgttctggaggcgtggagcctgaatgataatcattacaatgacaagaccgatggtgcggcactggcaatggagaataagcaacgtctggcgctgttgttttcgttggcgaaaccgatcaaagagcgtaccccggcagtgagcccgctgtataacaacaccttcaataccacccagcgtgatgaaaagaccgattggattaacaaagacggtagcaaggcttacaacgaagatggcacggtcaaacaatcgaccatcggtaagtacaacgagaaatacggtgacgcatccggtaactacgttttcatccgtgcccacgataacaacgtccaggacatcatcgccgagatcatcaagaaagagatcaacccgaaaagcgacggcttcaccatcaccgacgccgaaatgaagcaagcctttgaaatctataacaaagatatgctgtcgagcgacaaaaagtataccctgaataacattccggcagcgtatgccgtgatgttgcagaatatggaaacgattacccgcgtctattacggtgatctgtatacggacgacggtcactacatggaaaccaaatctccgtattacgataccatcgtgaatttgatgaagagccgtatcaagtatgtttcgggtggccaggcgcaacgtagctattggctgccgaccgacggtaagatggacaatagcgacgttgagctgtaccgcacgaatgaggtttacacgagcgtgcgctatggtaaggatatcatgaccgctaatgataccgaaggctctaagtattcccgcaccagcggccaagtcaccttggtcgcgaacaatccgaagctgaatctggaccaaagcgccaagttgaatgtggagatgggcaaaatccatgcgaatcagaagtatcgcgcactgattgtcggcactgcggacggcattaagaactttacttccgacgcggacgccattgcagcgggttatgtgaaagaaaccgatagcaacggcgtgctgaccttcggtgctaacgacattaagggctacgaaacgtttgatatgagcggtttcgtggcggtgtgggttccggtgggtgcatctgacaatcaggacattcgtgttgcgccgagcaccgaggcaaagaaagaaggtgagctgaccttgaaggcgacggaagcgtatgatagccagctgatttacgaaggctttagcaatttccagacgatcccagatggcagcgatccgtccgtgtatacgaaccgcaagattgcggagaacgtggatctgttcaaaagctggggtgtcaccagctttgagatggcaccgcaatttgtctcggcggatgatggcacctttctggatagcgttattcagaatggctacgccttcgccgaccgttatgacctggccatgtccaagaacaacaagtatggtagcaaagaggacctgcgtgatgcactgaaagcactgcataaggcgggtattcaagctatcgcagactgggttccagaccagatctaccagctgccgggcaaagaagttgtcaccgccacccgtacggatggtgctggccgtaagatcgcagacgcgattatcgaccattctctgtatgttgcaaacagcaaaagcagcggcaaagattatcaagcaaagtacggtggcgagttcctggccgagctgaaagccaaatacccggaaatgttcaaagttaacatgattagcacgggtaagccgattgatgactccgtgaaattgaagcaatggaaagccgagtacttcaatggcaccaacgttttggaacgtggtgtcggctatgttctgagcgacgaggcgaccggtaagtatttcacggtgaccaaagaaggcaatttcattccgctgcaactgacgggtaaagagaaagttatcacgggtttctccagcgatggtaagggtatcacctatttcggtacgagcggtacgcaggcgaagtctgcgtttgttaccttcaatggtaacacctactatttcgacgcgcgtggccacatggttaccaatagcgaatacagcccgaatggcaaggacgtctaccgttttctgccgaacggtatcatgctgagcaatgcgttttacattgatgcgaacggtaatacctacctgtacaactctaagggtcaaatgtacaaaggcggttacacgaaattcgatgtttctgaaacggataaggacggtaaagagtccaaggtcgtcaagttccgctactttacgaacgaaggcgtcatggccaagggtgttaccgtcattgatggttttacccaatacttcggtgaggacggctttcaagcgaaggataagctggtcaccttcaagggcaagacgtattacttcgacgcacacactggtaatggtatcaaagatacctggcgcaatatcaatggtaaatggtactatttcgacgcgaatggcgttgctgcgaccggtgcgcaggtgattaacggccagaaactgtacttcaacgaggatggctcccaagtcaaaggcggcgtggttaagaacgcagacggcacctatagcaaatacaaagaaggttttggtgagctggttactaacgagtttttcacgactgatggcaatgtttggtactacgccggtgcaaatggtaaaaccgttaccggtgcacaagtgatcaacggccaacatttgtacttcaatgcggacggttcccaggtgaagggtggcgttgtcaagaacgcggatggcacctacagcaagtacaatgctagcactggtgaacgtctgacgaacgagttctttacgaccggtgataacaattggtattacattggcgcaaacggtaagagcgtgacgggtgaggtcaagattggtgatgatacttactttttcgcgaaggatggcaaacaagttaaaggtcaaaccgtcagcgccggtaatggtcgcattagctactactacggtgacagcggcaagcgtgcggttagcacctggattgagattcagccgggtgtttatgtgtatttcgacaaaaacggtttggcgtaccctccgcgtgttctgaattaa

SEQ ID NO: 8 - protein, 1477 aa, Streptococcus salivarius
MDETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 9 - DNA, 4311 bp, Streptococcus downei
atggttgacggcaaatactactactacgatcaggacggcaacgtaaagaaaaacttcgcggttagcgtgggcgagaaaatctattactttgacgaaactggcgcctacaaagacaccagcaaagttgaggcggacaaaagcggcagcgacattagcaaggaagagactaccttcgcggcaaacaaccgcgcctacagcaccagcgcggagaattttgaggcgatcgacaattatctgaccgcggactcctggtatcgtcctaaatccatcctgaaggatggcaaaacgtggacggaaagcagcaaagatgactttcgtccgctgctgatggcgtggtggccggataccgaaacgaagcgcaattacgtgaactacatgaacaaagttgttggcatcgacaagacctataccgcggaaaccagccaggccgacttgaccgctgcggcggaactggtgcaagcacgcattgagcagaagatcacgaccgaacagaacacgaaatggctgcgtgaggcaatctcggcatttgttaaaacgcaaccgcagtggaacggtgaaagcgagaagccgtacgacgatcacctgcaaaacggtgctctgaaatttgataatcagagcgacctgaccccggatacgcaaagcaactaccgtctgttgaaccgtaccccgactaatcagacgggtagcctggacagccgcttcacttataacgcgaacgaccctttgggcggttatgagctgctgctggcaaatgacgtcgataacagcaatccgatcgtgcaggcggagcagctgaactggctgcattacctgctgaattttggtacgatctacgccaaagatgccgacgctaacttcgatagcattcgtgtggacgcggttgataacgtcgatgcggatctgctgcaaattagcagcgattacctgaaagcagcctacggcattgataagaataacaaaaacgcgaacaaccacgtgagcattgtcgaagcctggagcgataatgataccccgtacctgcatgacgatggtgacaacctgatgaatatggataacaaatttcgcctgtccatgctgtggtcgctggccaaaccgctggacaagcgtagcggtctgaacccgctgattcataacagcttggtggatcgtgaagttgatgaccgcgaggttgaaacggttccgagctattcttttgcacgtgcgcatgatagcgaggtccaggacttgatccgtgacatcatcaaggcagagatcaatccgaacgcattcggttatagctttacccaagacgagattgaccaggcctttaagatttacaatgaggatctgaagaaaacggataagaaatacacccactataatgtgccgttgagctacaccctgctgctgacgaataagggtagcatcccacgtgtctactatggtgatatgtttaccgacgatggtcagtatatggcgaacaaaaccgtcaactatgacgccattgaatctctgctgaaagcgcgtatgaagtatgtcgctggcggtcaagcaatgcagaactaccaaatcggtaatggtgagatcctgaccagcgttcgttatggtaagggtgccctgaaacagagcgacaaaggtgatgcgaccacgcgcaccagcggtgtcggtgtcgttatgggcaatcagccaaactttagcttggacggcaaagtggtggctctgaacatgggcgcagctcatgcgaatcaggagtatcgtgcgctgatggttagcacgaaagacggtgttgccacgtatgcgaccgatgcagatgcgagcaaagccggtctggtcaaacgtaccgacgaaaacggctacctgtatttcctgaatgacgacctgaagggtgtggccaatcctcaggtgagcggtttcttgcaggtgtgggttccggtgggtgccgcggatgatcaagatatccgtgttgcagctagcgataccgcatccaccgatggcaagagcctgcaccaagacgccgcgatggatagccgtgttatgtttgaaggcttctctaactttcagtcctttgccacgaaagaagaggaatataccaacgtcgttatcgccaacaatgtggataagttcgttagctggggtatcacggatttcgagatggccccacaatatgtttccagcaccgacggtcaattcctggactctgtcattcagaacggttatgcttttacggaccgttatgacttgggcatgtctaaggcaaacaaatacggcacggccgatcaactggttaaggccattaaggccctgcacgcgaagggcctgaaggttatggcagattgggtgccggatcagatgtataccttcccgaaacaggaagtcgtgaccgttacccgtaccgacaaatttggcaaaccgatcgcaggttcccaaatcaatcatagcctgtatgttaccgataccaagtccagcggcgatgactatcaggccaaatatggtggtgcgtttctggacgagctgaaggagaaatatccggagctgttcacgaagaaacaaatcagcacgggtcaagctattgacccgagcgtgaaaatcaaacagtggtctgctaagtatttcaatggctccaacatcctgggtcgcggtgcggactacgtactgtcggatcaggcgagcaacaaatacctgaacgtgtctgacgataaactgttcctgccgaaaaccttgctgggccaagttgtcgagagcggtatccgctttgacggcactggttatgtgtacaactctagcactacgggtgaaaaagttaccgattccttcattacggaggcaggtaatctgtactacttcggtcaagacggctatatggtgaccggcgcacagaacattaagggcagcaactattacttcctggccaatggtgcggccctgcgtaacaccgtttacaccgatgcgcaaggtcagaatcactattacggcaacgacggcaagcgttatgagaatggttaccaacagttcggcaacgattcttggcgttacttcaaaaatggcgtgatggcgctgggtctgactacggtggatggtcacgtgcagtatttcgataaagatggtgtccaggccaaggataagatcattgtcacccgcgatggcaaagtccgctatttcgaccagcacaacggtaatgcggttactaacacgttcgttgcggacaagacgggtcactggtactatctgggcaaagacggcgtcgcggttaccggtgcgcagactgtgggtaaacagcatttgtactttgaagcgaacggtcaacaagtcaagggtgacttcgtgacggctaaagacggtaaactgtacttctatgatgtggacagcggcgacatgtggaccaatacctttatcgaggataaagcgggtaattggttctacctgggtaaggacggtgcggccgtcaccggtgcacagacgatcaaaggccagaaattgtatttcaaagccaacggtcagcaagttaaaggtgacattgtcaaggacgcggacggtaagatccgttattacgacgctcagaccggtgaacaggtctttaacaagtccgttagcgtcaacggtaagacctactatttcggtagcgacggcaccgcgcaaacccaggcgaatccgaaaggccaaacctttaaggatggtagcggcgttctgcgtttctacaatttggagggccagtatgtctcgggcagcggctggtacgaaacggccgagcacgagtgggtatatgtgaaatccggtaaagttctgaccggtgcccagacgattggtaatcaacgtgtttacttcaaggacaatggtcaccaggtgaaaggccagctggtcacgggtaatgacggtaaattgcgttactacgacgcgaacagcggtgatcaagcattcaacaaatccgtcacggttaacggtaaaacctactactttggcagcgatggtacggcgcagacgcaggctaatcctaagggtcagaccttcaaagatggtagcggcgtgctgcgtttttacaacttggaaggccaatacgtgtctggcagcggttggtacaagaatgcgcagggccagtggctgtacgtgaaagatggcaaggtcctgaccggtctgcaaacggtcggcaatcagaaggtctacttcgacaaaaatggcatccaagcaaagggtaaggccgttcgcacgtccgatggtaaagtgcgctactttgatgagaatagcggtagcatgattacgaaccaatggaagttcgtttacggtcaatactattacttcggttctgacggcgcagcggtttaccgtggttggaactaa

SEQ ID NO: 10 - protein, 1436 aa, Streptococcus downei
MVDGKYYYYDQDGNVKKNFAVSVGEKIYYFDETGAYKDTSKVEADKSGSDISKEETTFAANNRAYSTSAENFEAIDNYLTADSWYRPKSILKDGKTWTESSKDDFRPLLMAWWPDTETKRNYVNYMNKVVGIDKTYTAETSQADLTAAAELVQARIEQKITTEQNTKWLREAISAFVKTQPQWNGESEKPYDDHLQNGALKFDNQSDLTPDTQSNYRLLNRTPTNQTGSLDSRFTYNANDPLGGYELLLANDVDNSNPIVQAEQLNWLHYLLNFGTIYAKDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDLIRDIIKAEINPNAFGYSFTQDEIDQAFKIYNEDLKKTDKKYTHYNVPLSYTLLLTNKGSIPRVYYGDMFTDDGQYMANKTVNYDAIESLLKARMKYVAGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQASNKYLNVSDDKLFLPKTLLGQVVESGIRFDGTGYVYNSSTTGEKVTDSFITEAGNLYYFGQDGYMVTGAQNIKGSNYYFLANGAALRNTVYTDAQGQNHYYGNDGKRYENGYQQFGNDSWRYFKNGVMALGLTTVDGHVQYFDKDGVQAKDKIIVTRDGKVRYFDQHNGNAVTNTFVADKTGHWYYLGKDGVAVTGAQTVGKQHLYFEANGQQVKGDFVTAKDGKLYFYDVDSGDMWTNTFIEDKAGNWFYLGKDGAAVTGAQTIKGQKLYFKANGQQVKGDIVKDADGKIRYYDAQTGEQVFNKSVSVNGKTYYFGSDGTAQTQANPKGQTFKDGSGVLRFYNLEGQYVSGSGWYETAEHEWVYVKSGKVLTGAQTIGNQRVYFKDNGHQVKGQLVTGNDGKLRYYDANSGDQAFNKSVTVNGKTYYFGSDGTAQTQANPKGQTFKDGSGVLRFYNLEGQYVSGSGWYKNAQGQWLYVKDGKVLTGLQTVGNQKVYFDKNGIQAKGKAVRTSDGKVRYFDENSGSMITNQWKFVYGQYYYFGSDGAAVYRGWN

SEQ ID NO: 11 - DNA, 3942 bp, Streptococcus mutans
atgattgacggcaaatactactactatgacaacaacggcaaagtacgcaccaatttcacgttgatcgcggacggtaaaatcctgcattttgatgaaactggcgcgtacaccgacactagcattgataccgtgaacaaggatattgtcacgacgcgtagcaacctgtataagaaatacaatcaagtgtatgatcgcagcgcgcagagcttcgagcatgttgatcactacctgacggcggaatcttggtaccgtccgaaatacattctgaaagatggcaagacctggacccagagcaccgagaaggacttccgtcctctgctgatgacctggtggccgagccaggaaacgcagcgccagtatgtcaacttcatgaacgcccagttgggtatcaacaaaacgtacgacgacaccagcaatcagctgcaattgaacatcgctgctgcaacgatccaagcaaagatcgaagccaaaatcacgacgctgaagaacaccgattggctgcgtcaaacgatcagcgcgttcgtcaaaacccaaagcgcttggaatagcgacagcgaaaagccgtttgatgaccatctgcaaaacggtgcggttctgtatgataacgaaggtaaattgacgccgtatgccaatagcaactatcgtattctgaaccgcacgccgaccaaccagaccggtaagaaggacccgcgttataccgccgacaacacgatcggcggctacgagtttctgctggccaacgacgtggataatagcaacccggtggttcaggccgagcagctgaactggctgcacttcctgatgaactttggtaatatctacgcaaacgaccctgacgctaacttcgactccatccgcgttgacgctgtcgataatgtggacgccgatctgttacagatcgcgggtgactatctgaaagcggcaaagggcatccataagaatgacaaagcggcgaacgaccacctgtccattctggaagcgtggagcgacaatgacactccgtatctgcatgatgatggcgacaacatgattaacatggataacaaactgcgcctgagcctgctgttctccctggcgaaaccgctgaatcagcgtagcggtatgaacccgttgattacgaacagcctggtcaaccgtactgatgataatgccgaaacggcggcagtgccaagctactcttttatccgtgcccacgatagcgaggtccaggatttgattcgtgatatcattaaggctgagattaacccgaacgtcgtcggttacagcttcacgatggaagagattaagaaggcatttgagatctacaataaggacctgttggccacggagaagaagtatacccactataacaccgcattgagctacgcgttgctgctgacgaacaagagcagcgtgccgcgtgtctactatggtgatatgtttacggacgatggtcaatacatggcccacaagaccattaactacgaggcaatcgaaaccctgctgaaagcacgtatcaagtacgtgtccggtggtcaggctatgcgcaaccagcaagtgggtaattcggagatcatcaccagcgtgcgttacggtaaaggtgcgctgaaggcgatggatacgggtgaccgcactacccgtacctctggtgtggcggtcattgagggcaacaacccgagcttgcgcctgaaggcttctgatcgtgtggttgtgaatatgggtgcggcccacaaaaatcaagcctatcgcccgctgctgttgacgaccgataacggcattaaggcctatcacagcgaccaagaagcggcaggcctggtgcgttacaccaacgaccgtggcgaactgatctttaccgcagccgacattaagggctacgcaaatccgcaagttagcggctacctgggcgtctgggtccctgttggcgcagcagctgatcaggacgttcgtgttgcggcgagcaccgcgccaagcacggacggcaagagcgttcaccagaacgcggctctggacagccgtgtgatgttcgagggtttctcgaacttccaggcatttgctaccaagaaagaagagtataccaatgtggtcatcgctaagaatgtggataagttcgcggagtggggtgtcaccgatttcgagatggctccgcaatacgtttctagcaccgacggtagctttttggatagcgtgattcaaaacggttatgcttttaccgaccgttacgacctgggcatcagcaagccgaacaaatatggcaccgcggacgatctggttaaagcgattaaggcattgcacagcaaaggcatcaaagttatggcggattgggttccggaccagatgtatgccctgccggaaaaagaggttgtgacggcaacccgtgttgacaaatacggtacgccggtagctggcagccagatcaaaaacacgctgtacgtggtcgatggtaaatctagcggtaaggaccagcaggcgaagtacggtggtgccttcctggaagagctgcaagcgaagtatccggaactgttcgcgcgcaaacagattagcaccggtgttccgatggacccgagcgtcaagattaagcaatggagcgcaaaatacttcaacggcacgaatatcctgggtcgtggtgctggttacgtgctgaaagatcaggcaaccaacacctactttaacatcagcgacaataaagagatcaatttcctgccaaagacgttgctgaaccaggattctcaagttggctttagctacgacggtaagggctatgtgtactacagcacctcgggctaccaggctaaaaacacgttcatcagcgagggtgacaagtggtattacttcgacaataacggttatatggttaccggcgcacagagcattaatggtgtgaactattacttcctgccgaatggtttacagctgcgtgatgcgattctgaaaaatgaggacggtacgtacgcgtattatggcaatgatggtcgccgctacgagaatggctattatcagtttatgagcggtgtttggcgccatttcaataatggcgagatgtccgttggtctgaccgtcattgacggtcaagttcaatactttgacgagatgggttaccaggcgaaaggcaaattcgttaccaccgcggatggtaagatccgttacttcgataagcagagcggcaatatgtatcgtaatcgtttcattgagaacgaagagggcaaatggctgtacctgggtgaggacggcgcggcagtcaccggtagccagacgatcaatggtcagcacctgtattttcgtgctaacggcgttcaggttaagggtgagttcgtgaccgatcgtcatggccgcatctcttattacgacggcaacagcggtgatcagatccgcaaccgtttcgtccgcaatgcgcaaggccagtggttttactttgacaacaatggctatgcagtaactggtgctcgtacgatcaacggccagcacctgtatttccgcgcgaacggtgttcaggtaaaaggtgagtttgttacggaccgccacggccgcattagctattatgatggtaatagcggtgaccaaattcgcaatcgtttcgtgcgtaatgcacagggtcagtggttctacttcgacaataatggttatgcagtcacgggtgcacgtaccattaacggccaacacctgtactttcgcgccaatggtgtgcaagtgaaaggcgaatttgttactgatcgttatggtcgtatcagctactatgatggcaattctggcgaccaaattcgcaatcgctttgttcgtaacgcccaaggtcaatggttctatttcgacaacaacggttacgcggtgaccggtgcccgcacgattaatggtcaacacttgtacttccgtgccaacggtgtccaggtgaagggtgaatttgtgaccgaccgctatggtcgcatttcttactacgacgcaaattccggtgaacgcgtccgtatcaattaa

SEQ ID NO: 12 - protein, 1313 aa, Streptococcus mutans
MIDGKYYYYDNNGKVRTNFTLIADGKILHFDETGAYTDTSIDTVNKDIVTTRSNLYKKYNQVYDRSAQSFEHVDHYLTAESWYRPKYILKDGKTWTQSTEKDFRPLLMTWWPSQETQRQYVNFMNAQLGINKTYDDTSNQLQLNIAAATIQAKIEAKITTLKNTDWLRQTISAFVKTQSAWNSDSEKPFDDHLQNGAVLYDNEGKLTPYANSNYRILNRTPTNQTGKKDPRYTADNTIGGYEFLLANDVDNSNPVVQAEQLNWLHFLMNFGNIYANDPDANFDSIRVDAVDNVDADLLQIAGDYLKAAKGIHKNDKAANDHLSILEAWSDNDTPYLHDDGDNMINMDNKLRLSLLFSLAKPLNQRSGMNPLITNSLVNRTDDNAETAAVPSYSFIRAHDSEVQDLIRDIIKAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKAMDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYALPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFNISDNKEINFLPKTLLNQDSQVGFSYDGKGYVYYSTSGYQAKNTFISEGDKWYYFDNNGYMVTGAQSINGVNYYFLPNGLQLRDAILKNEDGTYAYYGNDGRRYENGYYQFMSGVWRHFNNGEMSVGLTVIDGQVQYFDEMGYQAKGKFVTTADGKIRYFDKQSGNMYRNRFIENEEGKWLYLGEDGAAVTGSQTINGQHLYFRANGVQVKGEFVTDRHGRISYYDGNSGDQIRNRFVRNAQGQWFYFDNNGYAVTGARTINGQHLYFRANGVQVKGEFVTDRHGRISYYDGNSGDQIRNRFVRNAQGQWFYFDNNGYAVTGARTINGQHLYFRANGVQVKGEFVTDRYGRISYYDGNSGDQIRNRFVRNAQGQWFYFDNNGYAVTGARTINGQHLYFRANGVQVKGEFVTDRYGRISYYDANSGERVRIN

SEQ ID NO: 13 - DNA, 3972 bp, Streptococcus dentirousetti
atggttgacggcaaatactactactacgatgcagacggcaacgtaaagaaaaacttcgcggttagcgttggcgatgccattttctattttgatgaaacgggtgcctacaaagataccagcaaagttgatgcggataagaccagctctagcgtcaatcagaccacggaaacgttcgcagcgaataaccgtgcgtatagcaccgcagccgagaactttgaagcgattgataactacctgactgcggatagctggtatcgtccgaagtctatcttgaaagatggtacgacgtggaccgaaagcaccaaggatgattttcgcccgctgctgatggcgtggtggccggataccgaaaccaaacgtaactacgtgaactatatgaacaaggtggtcggtatcgacaaaacgtacaccgcggaaacgtcccaagctgacctgacggcggcagccgaactggtgcaggcgcgtatcgagcagaaaatcactagcgaaaagaatacgaagtggctgcgtgaggcgatttccgcgttcgttaagactcaaccgcagtggaatggcgagagcgagaaaccttatgatgaccacctgcaaaatggtgcgctgaagttcgacaatgaaaccagcctgaccccggatacgcagagcggctatcgcatcctgaaccgtaccccgacgaatcaaaccggtagcctggacccgcgcttcacctttaatcagaatgacccgctgggtggttatgagtatttgctggctaatgatgtcgataacagcaacccggtcgttcaggccgagagcctgaactggctgcattacctgctgaattttggtagcatttacgcgaatgatccggaggccaatttcgacagcatccgtgtggacgcggtggacaatgttgacgcagacctgctgcaaattagctcggattacctgaaatcggcgtacaaaattgacaagaacaacaaaaatgcgaacgaccacgttagcatcgtcgaggcgtggagcgacaatgataccccgtacctgaatgatgatggcgacaatctgatgaacatggataacaagtttcgtctgagcatgctgtggagcctggcgaagccaaccaatgtccgtagcggcttgaatccgctgatccacaacagcgtggttgaccgtgaggtggacgaccgtgaagttgaggctaccccgaattacagctttgcacgcgcacacgacagcgaagttcaagatttgattcgcgacatcatcaaagctgagatcaacccaaacagcttcggttatagctttacccaagaggaaatcgaccaggccttcaagatctacaatgaggatttgaagaaaaccaataagaagtatacccactacaacgtcccgctgagctacaccctgctgctgacgaacaagggcagcattccacgcatttactacggtgacatgtttacggatgacggtcagtatatggccaacaaaaccgttaactatgacgccattgagagcctgctgaaagcacgtatgaagtatgttagcggtggccaagcgatgcagaattacaacatcggcaacggcgagattctgaccagcgtccgttacggtaagggtgccctgaaacagagcgacaaaggcgataagactactcgtaccagcggtattggcgttgtgatgggtaaccagagcaatttcagcctggagggcaaggtggtggccctgaatatgggtgcaacgcataccaaacagaagtatcgtgcattgatggtgtctacggaaaccggcgtggcgatttacaatagcgatgaagaagcagaggcagcaggcctgatcaaaacgaccgatgagaatggttatttgtactttctgaatgacgatctgaagggcgtggctaacccgcaggtcagcggcttcctgcaagtgtgggttccggttggtgcaccggctgaccaggacattcgtgtggcggcgaccgatgcggcttctaccgacggtaagagcctgcatcaggacgcagctctggattctcgcgtcatgtttgaaggtttcagcaacttccagagcttcgcaaccaaggaagaggaatacaccaacgttgttattgcaaagaacgtggataagttcgtgagctggggtatcaccgacttcgagatggcaccgcagtacgttagctctaccgatggcacctttctggatagcgtgattcaaaatggctatgcctttacggaccgttacgacctgggtatgagcaaagcaaacaagtatggtactgctgaccaactggtggccgcgattaaagcgctgcatgcgaagggtctgcgtgtgatggcggattgggtcccagatcaaatgtacactttccctaagaaggaagtggttaccgttacccgtacggacaaatttggcaatccagtggcaggcagccaaatcaaccacaccttgtacgtcactgatactaagggtagcggtgacgactaccaggcgaagtacggtggcgcattcctggatgaactgaaagaaaagtacccggagctgtttaccaagaagcaaatcagcaccggtcaggcaatcgacccgagcgtgaaaatcaagcagtggagcgcgaagtacttcaacggtagcaatatcttgggtcgcggtgcgaactacgtgctgtccgaccaggcgtctaacaagtactttaacgtggccgaaggtaaagtctttctgccagcggcgatgctgggtaaggtcgtcgagagcggtatccgtttcgacggtaaaggttatatctataacagcagcaccactggcgaacaagtgaaggacagcttcattaccgaagcgggtaacttgtactattttggcaaagatggttatatggtcatgggtgcacagaatatccagggtgctaactactacttcttggcgaatggtgcggccctgcgcaatagcatcctgacggatcaggatggcaaaagccactattatgcaaatgacggcaagcgttatgagaacggctactatcaattcggtaacgactcctggcgctattttgaaaacggcgttatggccgttggtttgacgcgcgttgcgggccacgaccaatactttgataaggatggtatccaagcgaagaataagatcattgttacgcgtgacggtaaggtccgctacttcgacgaacacaacggcaatgctgccacgaatacgtttatcagcgatcaagccggccattggtactacctgggtaaagatggtgtcgccgtgacgggtgcgcagaccgttggcaagcaacacctgtacttcgaggctaacggccaacaagtaaaaggcgattttgttaccgccaaggacggtaagttgtattttctggacggtgactctggcgacatgtggaccgataccttcgtccaggataaggctggtcattggttctatctgggcaaagacggtgcggcggtaaccggtgcccagaccgtccgtggtcagaagctgtacttcaaagcgaatggccagcaggttaagggtgacattgtgaaaggcgcggatggtaaaatccgttactatgatgcaaattccggtgaccaggtttacaatcgcacggtgaaaggctccgacggcaagacctatatcattggtaatgacggcgtcgcaatcacgcaaaccatcgccaaaggccagaccatcaaggatggcagcgttctgcgcttctatagcatggagggtcagctggtgaccggcagcggctggtattccaacgcgaaaggtcaatggttgtatgtcaagaacggtcaagtcctgacgggtttgcagacggtgggcagccagcgtgtgtactttgacgcaaatggtattcaagcgaaaggtaaagcagtgcgtacctccgatggcaaactgcgttacttcgatgcgaacagcggcagcatgatcaccaatcagtggaaagaagttaatggtcagtactactatttcgacaacaacggtgttgcgatctatcgcggttggaactaa

SEQ ID NO: 14 - protein, 1323 aa, Streptococcus dentirousetti
MVDGKYYYYDADGNVKKNFAVSVGDAIFYFDETGAYKDTSKVDADKTSSSVNQTTETFAANNRAYSTAAENFEAIDNYLTADSWYRPKSILKDGTTWTESTKDDFRPLLMAWWPDTETKRNYVNYMNKVVGIDKTYTAETSQADLTAAAELVQARIEQKITSEKNTKWLREAISAFVKTQPQWNGESEKPYDDHLQNGALKFDNETSLTPDTQSGYRILNRTPTNQTGSLDPRFTFNQNDPLGGYEYLLANDVDNSNPVVQAESLNWLHYLLNFGSIYANDPEANFDSIRVDAVDNVDADLLQISSDYLKSAYKIDKNNKNANDHVSIVEAWSDNDTPYLNDDGDNLMNMDNKFRLSMLWSLAKPTNVRSGLNPLIHNSVVDREVDDREVEATPNYSFARAHDSEVQDLIRDIIKAEINPNSFGYSFTQEEIDQAFKIYNEDLKKTNKKYTHYNVPLSYTLLLTNKGSIPRIYYGDMFTDDGQYMANKTVNYDAIESLLKARMKYVSGGQAMQNYNIGNGEILTSVRYGKGALKQSDKGDKTTRTSGIGVVMGNQSNFSLEGKVVALNMGATHTKQKYRALMVSTETGVAIYNSDEEAEAAGLIKTTDENGYLYFLNDDLKGVANPQVSGFLQVWVPVGAPADQDIRVAATDAASTDGKSLHQDAALDSRVMFEGFSNFQSFATKEEEYTNVVIAKNVDKFVSWGITDFEMAPQYVSSTDGTFLDSVIQNGYAFTDRYDLGMSKANKYGTADQLVAAIKALHAKGLRVMADWVPDQMYTFPKKEVVTVTRTDKFGNPVAGSQINHTLYVTDTKGSGDDYQAKYGGAFLDELKEKYPELFTKKQISTGQAIDPSVKIKQWSAKYFNGSNILGRGANYVLSDQASNKYFNVAEGKVFLPAAMLGKVVESGIRFDGKGYIYNSSTTGEQVKDSFITEAGNLYYFGKDGYMVMGAQNIQGANYYFLANGAALRNSILTDQDGKSHYYANDGKRYENGYYQFGNDSWRYFENGVMAVGLTRVAGHDQYFDKDGIQAKNKIIVTRDGKVRYFDEHNGNAATNTFISDQAGHWYYLGKDGVAVTGAQTVGKQHLYFEANGQQVKGDFVTAKDGKLYFLDGDSGDMWTDTFVQDKAGHWFYLGKDGAAVTGAQTVRGQKLYFKANGQQVKGDIVKGADGKIRYYDANSGDQVYNRTVKGSDGKTYIIGNDGVAITQTIAKGQTIKDGSVLRFYSMEGQLVTGSGWYSNAKGQWLYVKNGQVLTGLQTVGSQRVYFDANGIQAKGKAVRTSDGKLRYFDANSGSMITNQWKEVNGQYYYFDNNGVAIYRGWN

SEQ ID NO: 15 - DNA, 4047 bp, Streptococcus oralis
atgatcgacggcaaaaactactacgtacaggatgatggcacggtaaagaagaatttcgcggtagaactgaatggtcgtatcctgtattttgatgcagaaaccggcgctctggttgatagcaacgagtatcagttccaacagggtacgagcagcctgaacaatgaattttctcagaagaacgcattctatggtacgaccgataaggatattgagactgtggatggctacctgaccgcagatagctggtatcgcccgaaattcatcctgaaggatggcaagacgtggaccgcgagcacggaaacggatctgcgtccgctgttgatggcatggtggccggacaagcgtacccaaatcaactatctgaactacatgaaccagcagggtctgggtgcgggtgcgtttgagaacaaagtggagcaggccctgctgacgggtgcaagccaacaggtacaacgcaagatcgaagagaagattggtaaagagggtgataccaagtggctgcgcaccctgatgggtgcgttcgtgaaaacgcaaccaaactggaatatcaaaaccgagtctgaaacgaccggcacgaaaaaggaccatctgcaaggcggtgcactgctgtatacgaacaacgagaaatccccgcacgcggacagcaaatttcgtctgctgaatcgtaccccgaccagccaaaccggcacgccgaagtatttcatcgacaagtctaacggtggctacgaatttctgctggcgaacgattttgacaatagcaatcctgcggtacaagctgagcagctgaattggctgcactacatgatgaactttggcagcattgttgcgaatgatccgaccgcgaatttcgacggcgttcgtgtggatgctgttgataacgtcaatgcggacttgttgcaaattgcaagcgattactttaagagccgttacaaagtcggtgagagcgaagaagaagcgatcaagcacctgtccatcctggaagcatggagcgataacgacccggactacaacaaagataccaagggtgcacagttggcgattgataacaaactgcgcctgagcctgctgtactctttcatgcgtaatctgagcatccgtagcggtgttgaaccgacgattaccaatagcctgaatgaccgttccagcgaaaagaagaacggcgagcgtatggcaaattacatcttcgtgcgtgcccacgatagcgaggtccaaacggtgatcgccgacatcattcgcgaaaacatcaatccgaacaccgacggcctgacgtttacgatggacgagctgaagcaggcattcaagatttacaacgaggacatgcgcaaggcggacaaaaagtatacccagtttaacattcctaccgcacacgcgctgatgctgtctaataaggattctattacccgcgtgtactatggtgatctgtatactgacgatggtcagtacatggagaagaaaagcccgtatcacgatgcgattgacgctctgctgcgtgcacgtattaaatacgtcgcgggtggccaggatatgaaagtgacctatatgggcgtgccgcgtgaagcggataagtggagctataacggcattctgaccagcgtgcgctatggcacgggcgctaacgaagccacggatgagggcactgcggaaacgcgcacgcaaggtatggcagtgattgcgagcaataatccaaatctgaaactgaatgaatgggacaagttgcaagtcaacatgggtgcggcgcataagaatcaatattaccgtccggttctgctgaccactaaggacggtatcagccgttatctgaccgatgaagaagtgcctcagagcctgtggaaaaagacggacgcaaacggtattctgaccttcgacatgaatgatattgctggctacagcaacgtgcaagttagcggttacctggccgtctgggtcccggtcggtgcgaaggcggatcaagatgcgcgcacgaccgcatccaagaagaaaaatgcgtcgggtcaggtgtacgaaagcagcgcggctctggatagccagctgatttacgaaggtttcagcaactttcaagactttgccactcgcgatgatcagtacacgaacaaggtcattgcgaaaaacgtgaatctgttcaaagaatggggtgtgaccagcttcgagctgccgccgcagtacgtgagcagccaagatggcacctttctggacagcattatccaaaacggctatgcatttgaagaccgttacgatatggcgatgagcaagaataacaagtatggtagcctgaaagacctgttgaacgcgctgcgcgcactgcacagcgtcaacattcaagcaatcgccgattgggtgccggaccaaatttacaacttgccgggcaaagaggtggtgaccgcaactcgtgtcaacaactacggcacctaccgtgagggtgctgaaatcaaagaaaagctgtatgtcgccaatagcaagaccaacgaaaccgatttccaaggtaaatacggtggtgcgttcctggatgagctgaaggcgaagtacccggagattttcgagcgtgtccaaatcagcaacggccaaaagatgactaccgatgaaaagatcaccaaatggagcgcgaaatactttaatggcaccaatattctgggtcgtggcgcgtactatgtcctgaaagattgggccagcaatgattacctgacgaaccgtaacggcgagattgttttgccgaagcaactggttaacaagaatagctataccggctttgtcagcgacgcgaacggcacgaagttctattctacctctggctaccaggcgaagaacagcttcattcaagacgaaaacggtaattggtattactttgacaaacgtggttatctggttacgggcgcacacgagattgatggcaagcatgtctacttcctgaaaaacggtatccaactgcgtgacagcatccgtgaggatgagaacggtaatcaatactattacgaccagaccggcgcacaagtgctgaaccgttactacacgacggacggtcagaattggcgctatttcgatgcgaaaggtgttatggcacgcggcctggtaaagattggtgacggccaacagtttttcgatgaaaacggttaccaggtcaagggcaagattgttagcgcaaaagacggcaagctgcgctactttgataaagactctggcaatgctgtcattaatcgtttcgcgcagggtgacaatccgagcgactggtactatttcggtgtggaatttgctaaactgacgggtttgcaaaagatcggccagcagacgctgtattttgaccaagacggtaagcaagtcaaaggtaagatcgtaactctgtcggacaaaagcattcgttacttcgatgccaacagcggtgaaatggcggttggcaagttcgcggaaggtgcaaagaatgagtggtattatttcgataaaaccggcaaagcggttactggtttgcagaaaattggtaagcagaccctgtactttgaccaggacggtaaacaggttaaaggcaaggttgtcacgctggctgataaaagcatccgctacttcgacgcagactccggcgagatggcggtcggtaagtttgcagagggtgcgaagaacgagtggtactattttgatcagactggcaaggccgtgactggtttgcaaaagattgacaagcaaaccttgtacttcgaccaggacggtaaacaagtcaagggtaagattgtgacgttgagcgacaagtcgatccgttactttgatgctaatagcggtgagatggctactaacaaattcgtcgagggctcgcagaatgaatggtactacttcgatcaagcgggtaaggctgttacgggcttgcaacaggtcggtcagcaaactctgtacttcacccaggatggtaagcaagtgaagggtaaggtcgtggacgtgaacggtgtttctcgttatttcgacgcaaactccggtgacatggctcgttctaaatggattcaactggaagatggcagctggatgtatttcgaccgtgacggtcgtggccagaattttggccgtaactaa

SEQ ID NO: 16 - protein, 1348 aa, Streptococcus oralis
MIDGKNYYVQDDGTVKKNFAVELNGRILYFDAETGALVDSNEYQFQQGTSSLNNEFSQKNAFYGTTDKDIETVDGYLTADSWYRPKFILKDGKTWTASTETDLRPLLMAWWPDKRTQINYLNYMNQQGLGAGAFENKVEQALLTGASQQVQRKIEEKIGKEGDTKWLRTLMGAFVKTQPNWNIKTESETTGTKKDHLQGGALLYTNNEKSPHADSKFRLLNRTPTSQTGTPKYFIDKSNGGYEFLLANDFDNSNPAVQAEQLNWLHYMMNFGSIVANDPTANFDGVRVDAVDNVNADLLQIASDYFKSRYKVGESEEEAIKHLSILEAWSDNDPDYNKDTKGAQLAIDNKLRLSLLYSFMRNLSIRSGVEPTITNSLNDRSSEKKNGERMANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYHDAIDALLRARIKYVAGGQDMKVTYMGVPREADKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKADQDARTTASKKKNASGQVYESSAALDSQLIYEGFSNFQDFATRDDQYTNKVIAKNVNLFKEWGVTSFELPPQYVSSQDGTFLDSIIQNGYAFEDRYDMAMSKNNKYGSLKDLLNALRALHSVNIQAIADWVPDQIYNLPGKEVVTATRVNNYGTYREGAEIKEKLYVANSKTNETDFQGKYGGAFLDELKAKYPEIFERVQISNGQKMTTDEKITKWSAKYFNGTNILGRGAYYVLKDWASNDYLTNRNGEIVLPKQLVNKNSYTGFVSDANGTKFYSTSGYQAKNSFIQDENGNWYYFDKRGYLVTGAHEIDGKHVYFLKNGIQLRDSIREDENGNQYYYDQTGAQVLNRYYTTDGQNWRYFDAKGVMARGLVKIGDGQQFFDENGYQVKGKIVSAKDGKLRYFDKDSGNAVINRFAQGDNPSDWYYFGVEFAKLTGLQKIGQQTLYFDQDGKQVKGKIVTLSDKSIRYFDANSGEMAVGKFAEGAKNEWYYFDKTGKAVTGLQKIGKQTLYFDQDGKQVKGKVVTLADKSIRYFDADSGEMAVGKFAEGAKNEWYYFDQTGKAVTGLQKIDKQTLYFDQDGKQVKGKIVTLSDKSIRYFDANSGEMATNKFVEGSQNEWYYFDQAGKAVTGLQQVGQQTLYFTQDGKQVKGKVVDVNGVSRYFDANSGDMARSKWIQLEDGSWMYFDRDGRGQNFGRN

SEQ ID NO: 17 - DNA, 4047 bp, Streptococcus sanguinis
atgattgatggtaaaaagtattacgtacaggacgacggcacggttaagaagaatttcgcggttgagctgaatggcaagatcctgtacttcgatgcagagactggtgcgttgattgacagcgcggagtatcaattccaacaaggcaccagcagcctgaataatgagttcactcaaaagaacgccttttacggtacgaccgataaggatgtggaaaccattgatggttacttgaccgccgattcctggtatcgtccgaagttcattctgaaagatggcaaaacctggacggcgagcacggaaattgacttgcgtccgttgttgatggcgtggtggccggacaaacagacccaggttagctacctgaattacatgaaccagcaaggcttgggtgcaggcgccttcgaaaacaaagtagagcaggcaattctgaccggtgcgtcccaacaggtacaacgtaaaatcgaagaacgcatcggtaaagagggtgataccaagtggctgcgtaccctgatgggtgcatttgtaaagacccagccgaactggaacattaagaccgagtccgaaaccactggcacgaataaagatcatctgcaaggtggcgcactgctgtatagcaattccgacaagacgagccatgccaactctaagtaccgtatcctgaaccgcaccccgaccaaccaaacgggcacgccgaaatactttattgacaagagcaatggtggttatgaatttctgctggcgaatgactttgacaatagcaatccggcagtgcaagcggaacagctgaactggttgcactttatgatgaattttggctccatcgttgcaaatgatccgacggccaacttcgacggcgtccgcgttgacgctgtggataacgtgaatgcggatctgttgcaaattgcgagcgactatttcaagagccgctataaagtcggcgaaagcgaagaagaggccattaagcacctgtccatcctggaagcgtggagcgacaacgacccggactacaacaaggatactaaaggtgcccaactgccgatcgacaacaaactgcgtctgagcctgctgtactccttcatgcgtaagctgagcatccgtagcggcgtcgagccgaccatcaccaactctctgaatgatcgcagcacggagaagaagaatggtgagcgtatggcaaactatatcttcgttcgtgcacatgatagcgaggtgcaaacggtcatcgccgacattatccgtgagaacatcaatccgaataccgacggcctgacgttcacgatggatgaactgaagcaggcctttaaaatttacaatgaggatatgcgtaaagccgacaaaaagtacacgcagttcaatatcccgaccgcgcacgcgctgatgctgagcaacaaagattctatcacccgcgtttactacggtgacctgtatacggatgacggtcagtatatggaaaagaaaagcccgtatcacgacgccattgacgctctgctgcgtgcgcgtatcaaatatgttgcgggtggtcaggacatgaaggtgacctatatgggcgtgccgcgtgaggcagataaatggagctataacggcatcctgaccagcgttcgttatggtacgggtgccaacgaggcaaccgacgagggtacggcagaaacccgtacccagggcatggccgtcattgccagcaacaatccgaacctgaaactgaacgagtgggacaagttgcaggtcaacatgggtgcagctcacaaaaaccaatactatcgtccggtgctgctgaccaccaaggacggcatctcgcgctacctgaccgacgaagaagtcccgcagagcctgtggaaaaagaccgatgcgaacggcatcttgacgtttgacatgaatgatattgcgggttacagcaacgtccaagtgagcggttatctggccgtctgggttcctgtgggtgcgaaggcggaccaggacgctcgtgttacggcatctaagaagaaaaatgcctctggccaagtttacgaaagcagcgcagccctggactcccagctgatctatgagggcttcagcaattttcaggactttgccacccgtgacgaccagtacactaacaaggttatcgcgaaaaacgtcaatctgtttaaagagtggggcgtcaccagcttcgaattgccgccacagtatgtgagcagccaagacggtacgttcctggatagcatcatccagaatggttatgcattcgaagatcgctatgatatggcgatgagcaaaaacaataagtacggtagcttgaacgacctgttgaacgccttgcgtgcactgcatagcgtgaatatccaagcgattgcggattgggtgccggaccagatttacaatctgccgggtaaagaagttgtcactgcaacccgtgttaacaattatggcacgtatcgtgagggtagcgagattaaagagaacctgtacgttgctaacaccaaaaccaatggtacggactaccaaggtaagtatggtggtgcgttcttggacgagctgaaagccaaataccctgagatttttgagcgcgtccaaatcagcaacggccagaagatgaccaccgacgagaagattacgaaatggtccgccaaacactttaacggcacgaacattctgggtcgtggtgcgtattatgtgctgaaagactgggcgagcaacgagtacctgaataacaaaaatggcgagatggttctgccgaagcagctggttaataaaaatgcatataccggcttcgtcagcgacgcgagcggcaccaaatactattctaccagcggctatcaggctcgtaatagctttattcaagatgaaaatggtaattggtactacttcaataaccgtggttatttggtgacgggtgcacaggaaatcgacggtaagcaactgtatttcctgaaaaacggcattcagctgcgtgattctctgcgtgaggacgaaaacggcaaccagtattactatgataagacgggtgcgcaagttctgaatcgttattacactacggacggccaaaattggcgctacttcgacgttaaaggcgtcatggcccgtggtctggtcacgatgggtggtaaccaacaattctttgaccaaaacggttaccaggttaaaggcaaaattgcgcgtgcaaaagacggtaaactgcgttacttcgataaagacagcggtaatgcggcagctaaccgtttcgcccaaggcgataaccctagcgactggtactatttcggtgcagatggtgttgcggttacgggcctgcaaaaggttggtcagcaaactctgtactttgatcaggacggcaagcaggtgaaaggtaaagttgttaccttggcggacaaaagcattcgttatttcgatgcaaacagcggcgagatggcggtgaacaagtttgtggaaggtgctaagaacgtgtggtactacttcgatcaagcaggcaaagcggtgaccggcctgcaaaccatcaataaacaagtgctgtatttcgaccaggatggtaaacaagtcaaaggtaaggtggtcacgctggctgataagtctatccgctacttcgacgcgaacagcggtgagatggcagtgggcaaattcgccgaaggcgcaaagaatgagtggtattactttgaccaggcgggcaaggctgttaccggtctgcaaaagatcggccaacagacgctgtatttcgaccagaacggtaaacaggttaagggtaaagtggtcaccctggcggataagagcatccgctatttcgacgctaactctggcgaaatggcaagcaataagttcgttgagggtgccaaaaatgaatggtactatttcgatcaggctggcaaggcagtgacgggtctgcaacaaattggccagcagaccctgtattttgaccagaatggcaaacaggtgaagggtaagattgtgtatgttaatggtgcgaatcgctactttgatgccaatagcggtgaaatggcgcgtaacaagtggattcagctggaagatggcagctggatgtattttgaccgcaatggtcgtggtcgtcgtttcggttggaactaa

SEQ ID NO: 18 - protein, 1348 aa, Streptococcus sanguinis
MIDGKKYYVQDDGTVKKNFAVELNGKILYFDAETGALIDSAEYQFQQGTSSLNNEFTQKNAFYGTTDKDVETIDGYLTADSWYRPKFILKDGKTWTASTEIDLRPLLMAWWPDKQTQVSYLNYMNQQGLGAGAFENKVEQAILTGASQQVQRKIEERIGKEGDTKWLRTLMGAFVKTQPNWNIKTESETTGTNKDHLQGGALLYSNSDKTSHANSKYRILNRTPTNQTGTPKYFIDKSNGGYEFLLANDFDNSNPAVQAEQLNWLHFMMNFGSIVANDPTANFDGVRVDAVDNVNADLLQIASDYFKSRYKVGESEEEAIKHLSILEAWSDNDPDYNKDTKGAQLPIDNKLRLSLLYSFMRKLSIRSGVEPTITNSLNDRSTEKKNGERMANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYHDAIDALLRARIKYVAGGQDMKVTYMGVPREADKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKADQDARVTASKKKNASGQVYESSAALDSQLIYEGFSNFQDFATRDDQYTNKVIAKNVNLFKEWGVTSFELPPQYVSSQDGTFLDSIIQNGYAFEDRYDMAMSKNNKYGSLNDLLNALRALHSVNIQAIADWVPDQIYNLPGKEVVTATRVNNYGTYREGSEIKENLYVANTKTNGTDYQGKYGGAFLDELKAKYPEIFERVQISNGQKMTTDEKITKWSAKHFNGTNILGRGAYYVLKDWASNEYLNNKNGEMVLPKQLVNKNAYTGFVSDASGTKYYSTSGYQARNSFIQDENGNWYYFNNRGYLVTGAQEIDGKQLYFLKNGIQLRDSLREDENGNQYYYDKTGAQVLNRYYTTDGQNWRYFDVKGVMARGLVTMGGNQQFFDQNGYQVKGKIARAKDGKLRYFDKDSGNAAANRFAQGDNPSDWYYFGADGVAVTGLQKVGQQTLYFDQDGKQVKGKVVTLADKSIRYFDANSGEMAVNKFVEGAKNVWYYFDQAGKAVTGLQTINKQVLYFDQDGKQVKGKVVTLADKSIRYFDANSGEMAVGKFAEGAKNEWYYFDQAGKAVTGLQKIGQQTLYFDQNGKQVKGKVVTLADKSIRYFDANSGEMASNKFVEGAKNEWYYFDQAGKAVTGLQQIGQQTLYFDQNGKQVKGKIVYVNGANRYFDANSGEMARNKWIQLEDGSWMYFDRNGRGRRFGWN

SEQ ID NO: 19 - DNA, 4023 bp, unknown
  unknown Streptococcus sp. C150
atgatcgacggcaaatactactacgtaaacgaggacggcagccacaaagagaatttcgcgatcacggttaatggtcaactgctgtattttggtaaggatggcgcgctgaccagcagcagcacgtacagcttcacccaaggcactaccaatattgtggacggttttagcattaacaaccgtgcgtatgactccagcgaggcctctttcgagctgattgacggttatctgactgcggactcttggtaccgtccggcgagcattatcaaagacggtgtgacgtggcaagcatccaccgccgaggacttccgcccgttgctgatggcgtggtggccgaacgttgatactcaggtgaactacctgaactacatgtccaaagtctttaatctggatgctaaatacagctcgactgataaacaggaaaccctgaaggtggcggcgaaagatatccagatcaaaattgaacaaaagattcaggcggaaaagtccacgcaatggctgcgtgaaacgatcagcgcctttgtaaaaacccagccgcaatggaacaaagagactgagaactacagcaagggcggtggtgaggaccatctgcaaggtggtgccctgctgtatgttaatgactctcgtaccccgtgggcgaacagcaactatcgtttgctgaaccgcacggcgaccaaccagaccggtacgatcgacaagagcatcctggacgagcagagcgatccgaatcacatgggtggttttgatttcttgctggctaatgacgttgacttgagcaatccggtcgtccaggcggaacaactgaatcagatccactacctgatgaattggggttctattgtcatgggtgataaagacgcgaattttgacggtattcgtgtagacgcggtggataatgttgatgcggacatgctgcaattgtacaccaactatttccgcgaatactatggtgtcaacaaaagcgaggcaaacgcgctggcgcacattagcgtcctggaagcctggagcctgaatgacaaccattacaatgataagactgatgttgcggcgctggcaatggagaataagcagcgcttggcactgttgtttagcctggcgaaaccgattaaagaacgcacgcctgccgtgtctccgctgtacaacaatacgtttaacaccactcagcgtgatgaaaagacggactggatcaataaagatggttcgaaagcctacaatgaggatggcactgtcaagaaaagcaccatcggcaagtataacgagaagtatggtgatgctagcggcaactacgttttcatccgcgctcacgacaataacgtgcaagacatcatcgcggagatcattaagaaagagattaacgagaaatctgacggttttaccattacggattcggagatgaagcgtgcatttgagatctataacaaagacatgctgtctaatgacaaaaagtacacgctgaataacatcccggcggcgtacgcggttatgctgcaaaacatggaaacgattacccgcgtgtattacggcgatctgtacacggacgacggtaattacatggaagcgaaaagcccgtactacgatacgattgttaacttgatgaagtctcgcatcaaatacgtgagcggtggccaggcgcagcgcagctactggctgccgaccgatggtaagatggataagtcggatgttgagctgtaccgtacgaacgaagtgtacacgagcgtccgttacggcaaagacattatgaccgccgatgacacgcaaggtagcaaatacagccgtaccagcggtcaggtgaccctggtcgtcaacaacccaaaactgaccttggaccaaagcgcaaagctgaacgtggttatgggcaagattcatgctaatcagaagtaccgcgcactgattgtcggtaccccgaacggtattaagaatttcaccagcgacgcagaggctattgccgcaggctatgtcaaagaaaccgatggcaatggcgtgctgaccttcggtgcaaacgacatcaagggttatgaaactttcgatatgagcggcttcgtcgctgtttgggttccggtcggtgcgagcgacgaccaagatattcgtgtggcggcgtctacggcagcaaagaaagagggtgagctgacgctgaaagcgaccgaagcctatgactcccaactgatctatgaaggctttagcaatttccagaccatcccagatggcagcgatccttctgtttataccaatcgtaagatcgcggaaaatgttgatttgttcaagagctggggtgtcacgagcttcgaaatggctccgcagttcgtttctgcggacgatggcacgtttctggacagcgtcattcaaaacggctatgcgttcgcagaccgttatgatctggccatgagcaaaaacaataagtacggtagcaaagaagatctgcgtaacgcgctgaaggcactgcacaaagcaggcattcaggcgattgcagattgggtgccagaccaaatctaccagctgcctggcaaagaagttgttactgccacccgcacggacggtgctggtcgcaaaatcagcgatgcaatcatcgatcattccctgtacgttgcgaactccaagagctccggtaaggactaccaagcgaagtacggtggcgagttcttggcggaactgaaggcgaaatacccggaaatgttcaaagtgaacatgattagcaccggcaaaccgattgatgatagcgtgaaactgaagcagtggaaagcagaatacttcaacggcaccaatgtgctggatcgcggtgtcggttatgttctgagcgatgaggcaaccggtaagtatttcaccgttaccaaagagggtaactttatcccgttgcagctgaagggtaacaagaaggtgattaccggcttttccagcgacggtaagggcattacctatttcggtactagcggtaaccaagctaaatccgcgttcgtcacttttaacggtaacacgtactacttcgacgcacgtggccacatggttaccaacggtgagtactcgccgaatggtaaagatgtgtatcgttttctgccgaacggcattatgctgagcaacgcgttctatgttgacggcaatggcaacacctacctgtacaactccaaaggccaaatgtataaaggtggctatagcaaatttgacgtcacggaaacgaaggacggtaaagagagcaaagttgtcaagttccgctactttacgaacgagggcgtgatggcgaaaggtgtcacggttgtggatggcttcactcagtactttaacgaggatggcattcaaagcaaagacgagctggtcacttacaatggcaagacctattacttcgaagcacacacgggcaatgccattaagaatacgtggcgtaatatcaagggcaaatggtaccattttgatgctaacggtgtcgcggctactggcgcacaggttatcaacggtcagcacctgtacttcaatgaagatggctctcaagtaaaaggtagcatcgtcaaaaacgctgatggtacgttcagcaagtacaaggacagctctggcgatctggtggtgaacgagtttttcacgacgggtgataacgtctggtactatgctggtgccaatggcaaaacggttactggtgcacaggtgattaatggccagcacttgttcttcaaagaggatggcagccaggtcaagggcgactttgtgaagaatagcgacggcacctactccaagtatgacgctgcgagcggcgaacgtctgaccaacgagttcttcactacgggcgacaatcattggtactatattggcgccaacggtaagaccgttaccggtgaagttaagattggtgacgacacgtatttcttcgcaaaagacggtaagcaactgaaaggtcaaatcgttaccacccgtagcggtcgtatcagctactactttggtgatagcggtaagaaggctattagcacgtgggtggagatccagccgggtgtgtttgttttcttcgacaaaaacggcctggcttacccaccggagaatatgaactga

SEQ ID NO: 20 - protein, 1340 aa, unknown
  unknown Streptococcus sp. C150
MIDGKYYYVNEDGSHKENFAITVNGQLLYFGKDGALTSSSTYSFTQGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSNYRLLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDVAALAMENKQRLALLFSLAKPIKERTPAVSPLYNNTFNTTQRDEKTDWINKDGSKAYNEDGTVKKSTIGKYNEKYGDASGNYVFIRAHDNNVQDIIAEIIKKEINEKSDGFTITDSEMKRAFEIYNKDMLSNDKKYTLNNIPAAYAVMLQNMETITRVYYGDLYTDDGNYMEAKSPYYDTIVNLMKSRIKYVSGGQAQRSYWLPTDGKMDKSDVELYRTNEVYTSVRYGKDIMTADDTQGSKYSRTSGQVTLVVNNPKLTLDQSAKLNVVMGKIHANQKYRALIVGTPNGIKNFTSDAEAIAAGYVKETDGNGVLTFGANDIKGYETFDMSGFVAVWVPVGASDDQDIRVAASTAAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRNALKALHKAGIQAIADWVPDQIYQLPGKEVVTATRTDGAGRKISDAIIDHSLYVANSKSSGKDYQAKYGGEFLAELKAKYPEMFKVNMISTGKPIDDSVKLKQWKAEYFNGTNVLDRGVGYVLSDEATGKYFTVTKEGNFIPLQLKGNKKVITGFSSDGKGITYFGTSGNQAKSAFVTFNGNTYYFDARGHMVTNGEYSPNGKDVYRFLPNGIMLSNAFYVDGNGNTYLYNSKGQMYKGGYSKFDVTETKDGKESKVVKFRYFTNEGVMAKGVTVVDGFTQYFNEDGIQSKDELVTYNGKTYYFEAHTGNAIKNTWRNIKGKWYHFDANGVAATGAQVINGQHLYFNEDGSQVKGSIVKNADGTFSKYKDSSGDLVVNEFFTTGDNVWYYAGANGKTVTGAQVINGQHLFFKEDGSQVKGDFVKNSDGTYSKYDAASGERLTNEFFTTGDNHWYYIGANGKTVTGEVKIGDDTYFFAKDGKQLKGQIVTTRSGRISYYFGDSGKKAISTWVEIQPGVFVFFDKNGLAYPPENMN

SEQ ID NO: 21 - DNA, 4479 bp, Leuconostoc mesenteroides
atgaccccatccgtattaggtgattcttccgtcccagatgtatcggctaacaatgtgcaatccgcgagcgataatacgacggacacccagcaaaataccaccatcaccgaggaaaatgataaggtccagagcgctgcgaccaacgataacgtgaccacggcagcgtccgacacgacgcagagcgccgataacaacgttaccgagaaacaatctgatgatcacgcgctggataatgaaaaggttgacaataagcaggacgaggtcgcccagaccaacgtgactagcaaaaacgaggagagcgcggtggcctctaccgacaccgatccggcagagactaccacggacgaaacgcaacaggttagcggcaagtatgtggaaaaggatggttcttggtattactactttgacgacggtaagaacgcgaagggtctgagcacgattgacaacaatatccaatactttgatgaaagcggtaagcaggtcaaaggtcagtatgtgacgattgataaccagacctattactttgataaagatagcggtgatgaactgaccggcctgcaatctattgacggtaacattgttgccttcaatgacgagggccagcagatctttaatcaatactaccagagcgagaacggtacgacctactattttgatgataagggccacgctgccaccggtattaagaatattgagggcaagaactactattttgacaatctgggtcaactgaaaaagggcttctccggcgtgatcgacggtcagattatgacgtttgaccaggaaactggtcaagaggtttccaataccacgtccgagatcaaagagggcctgacgactcagaacactgattactctgaacataatgcggcgcacggtaccgacgccgaagattttgagaacatcgatggctatctgaccgccagctcctggtaccgtccgacggacattctgcgcaatggcactgactgggaaccgagcaccgacacggactttcgtccaatcttgagcgtttggtggccggataagaatacgcaggtcaactatctgaactacatggcggacctgggcttcattagcaacgcagacagcttcgaaacgggtgactctcagagcctgctgaacgaggcgtccaattacgtccagaaaagcatcgagatgaaaatctccgcgcaacagagcaccgagtggctgaaagacgccatggccgcgtttattgttacgcagccgcaatggaatgaaacttccgaagatatgagcaacgaccacttgcaaaacggtgcgctgacctacgttaacagcccgctgaccccggacgcaaacagcaactttcgcctgctgaatcgtacccctaccaaccagaccggcgaacaggcgtacaacctggataattctaaaggtggctttgagctgctgctggcaaatgatgtggataacagcaacccggtggttcaagcggaacaactgaattggctgtactacctgatgaatttcggtacgattaccgccaatgacgcggatgccaactttgacggcattcgcgtcgatgcagtggataacgtggatgctgatctgttgcagattgcggcagactactttaaactggcctacggtgtggaccagaatgatagcaccgcaaaccaacacctgtctatcctggaagattggagccacaacgacccgctgtatgtcacggatcaaggcagcgaccagctgactatggacgactacgtgcatacgcaattgatttggagcctgaccaaaagcagcgatatccgtggtaccatgcaacgttttgtggattactatatggtggaccgttccaatgactccacggagaatgaagcgatcccgaattacagctttgtccgcgcacacgatagcgaagttcaaaccgttatcgcgcaaatcgtgagcgatctgtatccagatgttgagaatagcctggctccgaccaccgagcagctggcagcagcattcaaggtgtataatgaagatgagaaattggccgacaaaaagtatacccaatacaacatggcgagcgcctatgcgatgctgctgaccaataaagacacggtgccgcgtgtctactatggcgacctgtataccgatgacggtcaatacatggcaacgaagagcccgtattacgacgcgattaacaccctgctgaaagctcgtgttcaatatgtcgcgggtggccaaagcatgagcgtggatagcaacgatgtgctgaccagcgttcgctatggcaaagacgcgatgacggcgagcgacacgggcaccagcgagactcgtaccgagggcgtcggtgtcattgtgtccaacaatgcggagctgcaactggaagatggtcatacggttaccctgcacatgggtgccgcgcacaaaaatcaggcataccgtgcgttgttgtccaccacggccgacggtctggcgtattatgatacggacgagaatgccccggtggcatatacggatgcgaacggtgacttgattttcaccaatgagtccatctacggcgttcagaatccgcaagtcagcggttacctggcggtgtgggtcccggttggtgcacaacaggaccaggacgcgcgcacggcaagcgataccaccactaacaccagcgataaagttttccacagcaacgcggctctggacagccaagtgatctacgagggcttcagcaacttccaagcgtttgcgactgattccagcgaatacaccaatgttgttattgctcagaacgctgatcaattcaaacaatggggcgtgacctcgtttcagctggctccgcagtaccgcagcagcacggacacttccttcctggatagcatcatccaaaatggttacgcgtttacggaccgctatgatctgggttatggcacgccgacgaagtacggtaccgcggaccaactgcgtgatgcaatcaaagcactgcatgcgagcggcatccaagcgattgcagattgggttccggaccagatttacaatctgccggagcaagaactggcgactgtcacgcgcacgaatagcttcggtgatgatgatactgacagcgacattgataatgctctgtatgtggttcaaagccgcggtggtggtcagtaccaagagatgtatggcggtgcgtttctggaggagttgcaagcgctgtaccctagcctgtttaaggtgaaccagatttctactggtgtcccgatcgatggtagcgtgaagattaccgagtgggctgcgaaatacttcaacggcagcaatatccagggtaagggtgcgggttacgtgttgaaagacatgggtagcaataagtacttcaaggtcgtgagcaataccgaggacggcgactatctgccgaaacagctgaccaacgacctgagcgaaaccggtttcacccacgacgacaagggtatcatctactacaccctgagcggctatcgtgcacagaacgccttcattcaagacgatgataacaattactattactttgacaagaccggtcacctggtcacgggtttgcagaaaatcaacaaccatacgtacttcttcctgccgaatggcattgagctggtgaaatccttcttgcagaacgaggatggcacgatcgtttacttcgataagaaaggtcatcaagtctttgatcaatacattacggatcaaaatggcaacgcgtactatttcgacgatgccggtgttatgctgaagtctggtctggcaacgattgatggtcatcagcagtacttcgatcagaatggcgttcaagttaaggacaagttcgttatcggtacggatggctacaagtactacttcgagccgggttgcggcaatttggcaattttgcgttacgtgcaaaatagcaagaaccaatggttctatttcgatggcaatggccacgcagtcacgggtttccaaaccatcaacggcaagaagcagtatttctacaacgatggtcaccaaagcaagggcgaatttatcaatgcggacggtgacaccttctacaccagcgccaccgacggtcgtttggtgacgggtgttcagaagatcaacggtatcacctacgcgtttgacaataccggcaacctgatcacgaaccagtattatcagctggcggacggtaagtacatgctgctggacgactctggtcgcgcaaaaacgggctttgtcctgcaagacggtgtcctgcgttatttcgaccagaacggtgaacaagtgaaggacgccattatcgtcgacccggacaccaacctgtcttattactttaacgcgacccagggtgtcgcggtgaaaaacgattacttcgagtaccaaggcaactggtacctgaccgatgcaaactaccagctgattaaaggcttcaaagcagttgacgactcgctgcaacacttcgacgaagttacgggtgtgcagaccaaggaaagcgctctgattagcgcacagggcaaagtttaccagttcgacaacaatggtaacgcggtgagcgcataa

SEQ ID NO: 22 - protein, 1492 aa, Leuconostoc mesenteroides
MTPSVLGDSSVPDVSANNVQSASDNTTDTQQNTTITEENDKVQSAATNDNVTTAASDTTQSADNNVTEKQSDDHALDNEKVDNKQDEVAQTNVTSKNEESAVASTDTDPAETTTDETQQVSGKYVEKDGSWYYYFDDGKNAKGLSTIDNNIQYFDESGKQVKGQYVTIDNQTYYFDKDSGDELTGLQSIDGNIVAFNDEGQQIFNQYYQSENGTTYYFDDKGHAATGIKNIEGKNYYFDNLGQLKKGFSGVIDGQIMTFDQETGQEVSNTTSEIKEGLTTQNTDYSEHNAAHGTDAEDFENIDGYLTASSWYRPTDILRNGTDWEPSTDTDFRPILSVWWPDKNTQVNYLNYMADLGFISNADSFETGDSQSLLNEASNYVQKSIEMKISAQQSTEWLKDAMAAFIVTQPQWNETSEDMSNDHLQNGALTYVNSPLTPDANSNFRLLNRTPTNQTGEQAYNLDNSKGGFELLLANDVDNSNPVVQAEQLNWLYYLMNFGTITANDADANFDGIRVDAVDNVDADLLQIAADYFKLAYGVDQNDSTANQHLSILEDWSHNDPLYVTDQGSDQLTMDDYVHTQLIWSLTKSSDIRGTMQRFVDYYMVDRSNDSTENEAIPNYSFVRAHDSEVQTVIAQIVSDLYPDVENSLAPTTEQLAAAFKVYNEDEKLADKKYTQYNMASAYAMLLTNKDTVPRVYYGDLYTDDGQYMATKSPYYDAINTLLKARVQYVAGGQSMSVDSNDVLTSVRYGKDAMTASDTGTSETRTEGVGVIVSNNAELQLEDGHTVTLHMGAAHKNQAYRALLSTTADGLAYYDTDENAPVAYTDANGDLIFTNESIYGVQNPQVSGYLAVWVPVGAQQDQDARTASDTTTNTSDKVFHSNAALDSQVIYEGFSNFQAFATDSSEYTNVVIAQNADQFKQWGVTSFQLAPQYRSSTDTSFLDSIIQNGYAFTDRYDLGYGTPTKYGTADQLRDAIKALHASGIQAIADWVPDQIYNLPEQELATVTRTNSFGDDDTDSDIDNALYVVQSRGGGQYQEMYGGAFLEELQALYPSLFKVNQISTGVPIDGSVKITEWAAKYFNGSNIQGKGAGYVLKDMGSNKYFKVVSNTEDGDYLPKQLTNDLSETGFTHDDKGIIYYTLSGYRAQNAFIQDDDNNYYYFDKTGHLVTGLQKINNHTYFFLPNGIELVKSFLQNEDGTIVYFDKKGHQVFDQYITDQNGNAYYFDDAGVMLKSGLATIDGHQQYFDQNGVQVKDKFVIGTDGYKYYFEPGCGNLAILRYVQNSKNQWFYFDGNGHAVTGFQTINGKKQYFYNDGHQSKGEFINADGDTFYTSATDGRLVTGVQKINGITYAFDNTGNLITNQYYQLADGKYMLLDDSGRAKTGFVLQDGVLRYFDQNGEQVKDAIIVDPDTNLSYYFNATQGVAVKNDYFEYQGNWYLTDANYQLIKGFKAVDDSLQHFDEVTGVQTKESALISAQGKVYQFDNNGNAVSA

SEQ ID NO: 23 - DNA, 3972 bp, Streptococcus criceti
atggttgatggcaaatactactactacgacgcagatggcaacgttaagaagaatttcgcgattagcgtcggtgacgcaatcttctactttgacgaaaccggtgcttacaaggacaccagcaaagttggtgcggataaaaccagcagcagcgcgaatcaaaccacggccaccttcgcggcaaacaaccgtgcctatagcactgcggcggagaactttgaggcaattgacaactatttgaccgcagacagctggtatcgtccgaagagcattctgaaagatggtaagacgtggaccgaatccaccaaagacgacttccgtccgctgctgatggcttggtggccggataccgaaactaaacgcaactatgtcaactatatgaataaggtcgtcggcattgataaaacctataccgcggagactagccaagccgacctgacggcagctgcggagctggttcaagcgcgcattgagcaacgcatcacgtctgagaagaacacgaaatggctgcgcgaggctattagcgcgtttgtcaagacccagccgcaatggaatggcgagtccgaaaagccgtatgatgatcatttgcagaacggtgcactgaagttcgacaacgaaacctctctgaccccggacacccagtctggttatcgtatcttgaatcgcacgccgaccaatcaaacgggcagcctggacccgcgtttcacctttaatcaaaatgatccgctgggtggctatgaatatctgctggcaaacgacgtggataatagcaacccggtggtgcaagcggagagcttgaattggctgcactacctgctgaacttcggcagcatctacgcgaatgatccggaagcgaatttcgattccattcgtgtagacgccgtggataacgtggatgcggatctgttgcagattagcagcgactacctgaaatctgcgtacaaaatcgataagaacaacaaaaatgcgaatgaccacgtgagcatcgttgaggcgtggagcgataacgacaccccgtacctgcacgatgaaggcgataacttgatgaatatggacaataagtttcgcctgagcatgttgcgctccctggcgaagcctctggacaaacgtagcggcctgaaccctctgatccataatagcgtcgttgatcgcgaggtggatgaccgtgaggttgagaaaattccgagctactcttttgcacgcgctcacgacagcgaggttcaggatctgattcgtgacatcattaaggcagaaatcaatccgaacagcttcggctacagctttacccaagaagaaatcgatcaagcgttcaagatctacaacgaggacctgaagaaaaccaacaagaagtacacccattacaatgtcccgctgtcttacaccttgctgctgacgaataagggtagcattccgcgtatttactacggcgacatgtttaccgacgatggccagtatatggcgaacaaaacggtgaattacaatgctattgagagcctgctgaaggctcgtatgaagtatgtgagcggtggtcaggcgatgcaaaactatcaaattggtaatggtgaaattctgacgtcggtgcgctacggtaaaggtgcgctgaagcaatcggacaagggcgacgcaacgacgcgtacctctggtattggtattgtcatgggcaaccagccgaatttctcgctggaaggtaaagtcgttgccctgaacatgggtgcagcgcatgccaatcaggagtatcgtgccctgatggtgagcactaaagacggcgtggcgacctatgcgacggatgcagacgcgagcaaagcgggtatgacgaaacgtaccgacgagaacggctacttgtatttcctgaatgacgacttgaagggtgttgcaaatccacagatctccggttttctgcaagtatgggtgccggtcggtgctcctgccgaccaggatattcgcgttgccgcgacgaacgctgcaagcacggatggtaagtccctgcaccaagatgcggcgatggatagccgtgttatgttcgagggtttttccaactttcaggcgttcgcaacgaaagaagatgagtatgctaatgttgttattgcgaaaaatgtggataagtttgttagctggggcatcactgactttgagatggcaccgcagtatacctctagcgatgacggtcagttcctggatagcgttattcagaatggttatgcattcacggaccgttatgatctgggtatgagcaaggcaaacaaatatggtacggcggaacacctggtcaaagctatcaaagcgttgcacaaagcaggtctgaaagttatggcggattgggtcccggaccagatgtatacctttccgaagaaagaggttgtcaccgttacgcgtacggacaagttcggtaaaccggttgcgggcagccaaatcaatcataccctgtatgtgactgacaccaaaggtagcggtgatgactatcaggccaaatacggtggtgcgtttctggacgagctgaaagagaaatacccggaattgtttacgaaaaagcagatttctacgggccaagcaatcgacccaagcgtcaagattaagcagtggagcgcgaaatactttaacggcagcaatatcttgggtcgtggtgcaaattacgtcctgagcgaccaggccagcaacaagtatttcaatgtggcggaaggtaaggtttttctgccaggcgccatgctgggcaaggtggtggaaagcggcatccgttttgacggcaagggctacatctataacagctcgaccaccggcgaacaagtcaaagatagcttcatcacggaagcaggtaatttgtattacttcggtaaagacggttacatggtcatgggtgcgcagaacattcaaggcgccaattactacttcctggccaacggtgcggcactgcgtaatagcatcctgaccgatcaagacggcaagtcccactactacgcgaacgacggcaaacgttatgaaaacggctattatcagtttggtaacgattcctggcgctacttcgagaatggtgtaatggccgtcggcgtgacccgtgtggctggccatgaccagtacttcgataaggatggtattcaagcgaagaacaagatcatcgttacccgcgatggtaaggttcgttacttcgatgagcacaatggcaatgcagtcaccaacacgttcattagcgatcaggcaggtcactggtactatctgggtaaggacggtgtggcggtgacgggtgcccaaacggtgggcaaacagcacctgtatttcgaggccaacggccagcaggtcaaaggcgattttgtgaccgcgaaagacggtaaactgtatttcttcgatggcgatagcggtgacatgtggaccgacacgttcgtccaagacaaaactggccattggttttacctgggtaaagatggtgcggcggtcaccggtgcacagaccgtgcgcggtcagaaattgtactttaaagccaacggtcagcaagttaagggcgacattgtcaaaggtgctgatggtaaaatccgttactatgatgcaaattcgggcgatcaggtctacaaccgtactgtgaagggttccgacggtaaaacctacatcatcggcaaagacggtgttgccattacgcagaccatcgcgaagggtcaaaccattaaggacggcagcgttctgcgtttctacagcatggaaggccagctggttaccggtagcggctggtattctaacgcgaaaggtcagtggctgtacgtgaagaatggtcaggttctgaccggtctgcaaaccgttggttcccaacgtgtgtacttcgacgctaacggtatccaagcgaagggcaaggccgtgcgcaccagcgacggtaagctgcgttactttgatgcgaacagcggtagcatgatcactaaccagtggaaagaggtgaacggtcaatactattactttgacaacaatggcgtcgccatctaccgcggctggaactaa

SEQ ID NO: 24 - protein, 1323 aa, Streptococcus criceti
MVDGKYYYYDADGNVKKNFAISVGDAIFYFDETGAYKDTSKVGADKTSSSANQTTATFAANNRAYSTAAENFEAIDNYLTADSWYRPKSILKDGKTWTESTKDDFRPLLMAWWPDTETKRNYVNYMNKVVGIDKTYTAETSQADLTAAAELVQARIEQRITSEKNTKWLREAISAFVKTQPQWNGESEKPYDDHLQNGALKFDNETSLTPDTQSGYRILNRTPTNQTGSLDPRFTFNQNDPLGGYEYLLANDVDNSNPVVQAESLNWLHYLLNFGSIYANDPEANFDSIRVDAVDNVDADLLQISSDYLKSAYKIDKNNKNANDHVSIVEAWSDNDTPYLHDEGDNLMNMDNKFRLSMLRSLAKPLDKRSGLNPLIHNSVVDREVDDREVEKIPSYSFARAHDSEVQDLIRDIIKAEINPNSFGYSFTQEEIDQAFKIYNEDLKKTNKKYTHYNVPLSYTLLLTNKGSIPRIYYGDMFTDDGQYMANKTVNYNAIESLLKARMKYVSGGQAMQNYQIGNGEILTSVRYGKGALKQSDKGDATTRTSGIGIVMGNQPNFSLEGKVVALNMGAAHANQEYRALMVSTKDGVATYATDADASKAGMTKRTDENGYLYFLNDDLKGVANPQISGFLQVWVPVGAPADQDIRVAATNAASTDGKSLHQDAAMDSRVMFEGFSNFQAFATKEDEYANVVIAKNVDKFVSWGITDFEMAPQYTSSDDGQFLDSVIQNGYAFTDRYDLGMSKANKYGTAEHLVKAIKALHKAGLKVMADWVPDQMYTFPKKEVVTVTRTDKFGKPVAGSQINHTLYVTDTKGSGDDYQAKYGGAFLDELKEKYPELFTKKQISTGQAIDPSVKIKQWSAKYFNGSNILGRGANYVLSDQASNKYFNVAEGKVFLPGAMLGKVVESGIRFDGKGYIYNSSTTGEQVKDSFITEAGNLYYFGKDGYMVMGAQNIQGANYYFLANGAALRNSILTDQDGKSHYYANDGKRYENGYYQFGNDSWRYFENGVMAVGVTRVAGHDQYFDKDGIQAKNKIIVTRDGKVRYFDEHNGNAVTNTFISDQAGHWYYLGKDGVAVTGAQTVGKQHLYFEANGQQVKGDFVTAKDGKLYFFDGDSGDMWTDTFVQDKTGHWFYLGKDGAAVTGAQTVRGQKLYFKANGQQVKGDIVKGADGKIRYYDANSGDQVYNRTVKGSDGKTYIIGKDGVAITQTIAKGQTIKDGSVLRFYSMEGQLVTGSGWYSNAKGQWLYVKNGQVLTGLQTVGSQRVYFDANGIQAKGKAVRTSDGKLRYFDANSGSMITNQWKEVNGQYYYFDNNGVAIYRGWN

SEQ ID NO: 25 - DNA, 4308 bp, Streptococcus sobrinus
atggttgacggcaaatactactattatgatcaggatggcaacgttaagaagaatttcgcggttagcgttggtgacaagatctactactttgacgagactggtgcctacaaagacacctctaaagtggacgcggacaagtctagcagcgccgttagccaaaatgcgacgatctttgcggctaacaatcgtgcgtatagcacctctgctgagaactttgaggccgttgataactatctgacggcagatagctggtatcgtcctaaatctattctgaaagatggcaagacgtggaccgagtcgggtaaggacgacttccgtccgctgctgatggcgtggtggccggacacggagactaaacgcaattacgtgaattacatgaacctggttgtcggcatcgacaagacgtacaccgcggaaacctctcaagcagatttgaccgcagcggcggagctggtccaggcgcgtattgaacagaaaatcaccacggaacagaatacgaaatggctgcgcgaggcgatctctgctttcgtcaagacccagccgcagtggaatggtgaaagcgagaagccgtatgacgaccacctgcaaaacggtgctctgaaattcgataatcagagcgacctgaccccggacacccagagcaactatcgcctgctgaatcgcaccccgactaaccagactggcagcctggacagccgtttcacctataatgcgaacgatccgttgggtggctacgaatttctgctggctaacgacgtggataatagcaaccctgtggtgcaggcagaacaactgaactggttgcattacctgttgaattttggtagcatttacgcgaaagatgcggatgcaaacttcgattccatccgtgtggacgccgtggacaacgtcgatgcagatctgttgcagattagcagcgattacctgaaggcagcctatggcattgacaagaacaataagaacgcgaacaaccatgttagcattgttgaggcttggagcgataacgatacgccgtacctgcacgatgacggtgataacctgatgaacatggacaataagttccgcttgagcatgctgtggagcctggccaagccgctggacaagcgcagcggtctgaatcctctgattcataacagcctggtggaccgtgaggttgatgaccgtgaagtggaaacggttccgagctactcttttgcgcgtgcgcatgattccgaggtccaagacattatccgcgacattatcaaggccgaaatcaacccgaatagctttggttatagcttcacccaagaagagattgaccaggcgtttaagatctataatgaagatctgaagaaaaccgacaagaaatacacccactataatgtcccgttgagctatactttgctgctgacgaataaaggttcgattccgcgtgtgtattacggtgatatgttcaccgatgatggtcaatacatggcgaacaaaacggttaactatgatgccattgagtcgctgctgaaagcgcgcatgaagtacgttagcggcggtcaagcgatgcaaaactatcaaatcggcaatggtgagattctgaccagcgttcgttatggtaagggtgcattgaagcaatccgacaagggtgacgcgaccacgcgtacgtccggtgtgggcgtcgtgatgggcaaccagccgaactttagcctggacggcaaggtggtggcattgaacatgggtgccgctcatgcaaatcaggagtatcgtgcgctgatggtgagcaccaaggatggcgttgccacgtatgccaccgacgcggacgcaagcaaggcaggtctggtcaaacgcaccgatgaaaatggttatttgtactttctgaacgacgatctgaagggtgtggcaaacccacaagtcagcggtttcttgcaggtgtgggtcccagtgggtgcggctgacgatcaggacattcgtgttgcagcgagcgacacggctagcacggacggtaagtccctgcatcaagatgcggcaatggatagccgtgttatgtttgagggttttagcaacttccagagctttgcaaccaaagaagaagagtacaccaacgtagttattgcgaacaacgtggacaaattcgttagctggggtattaccgactttgagatggcaccgcaatatgtcagctccaccgatggccagtttctggatagcgttatccagaatggttacgcgttcaccgaccgttatgatctgggtatgagcaaagccaacaaatacggtaccgcggatcagctggttaaagcaatcaaagcgttgcacgcgaagggtctgaaggtgatggcggactgggttccagaccagatgtacacgtttccgaagcaggaagttgtcactgtcacgcgcaccgacaaatttggtaagccgattgcgggcagccaaatcaatcacagcctgtacgtgacggacaccaaatccagcggtgatgattaccaggccaaatatggtggtgcgttcctggatgagctgaaagagaaatacccggagctgttcaccaaaaagcagatctcgaccggtcaggcgatcgacccgagcgtgaagattaagcagtggagcgcgaaatactttaatggtagcaacattctgggtcgtggtgccgactacgtcctgtccgatcaagttagcaacaagtatttcaatgtggccagcgacacgctgtttctgccgtctagcctgttgggtaaggttgtcgaaagcggtattcgttacgatggcaaaggttatatctataacagcagcgcgactggcgaccaagtcaaggcgtcttttatcacggaagcaggcaatctgtactacttcggcaaagacggttacatggttactggtgcgcagaccattaacggtgcgaattacttcttcttggaaaatggtacggccctgcgtaataccatctacaccgatgcacagggcaactcccactattatgctaatgatggcaagcgttacgagaacggttaccagcagttcggcaacgattggcgttacttcaaagatggtaacatggccgtcggtctgaccacggtggatggtaacgttcagtatttcgacaaggacggtgtccaagctaaagacaagattattgtgacccgcgatggtaaggtgcgctactttgatcaacacaatggcaacgcggtcacgaatacctttatcgccgacaagaccggtcactggtactacctgggcaaagatggcgtcgcggtcaccggcgctcaaaccgtcggtaagcaaaaactgtattttgaggcgaacggtgagcaggtgaaaggcgactttgtgactagccatgaaggcaaactgtacttttatgatgttgacagcggcgacatgtggaccgataccttcatcgaggataaggccggcaactggttctacctgggtaaagacggcgcagcagttagcggtgcacagaccattcgcggtcaaaagctgtacttcaaggcgtacggtcaacaggtcaaaggtgacatcgttaaaggcaccgacggcaagatccgttactacgatgcgaaatccggcgagcaggttttcaataagacggtcaaagccgctgatggcaaaacctatgtgatcggcaacaatggtgtggcggtcgatccgagcgttgttaagggtcagacgttcaaagacgccagcggcgcactgcgtttttacaatctgaaaggtcaactggttacgggctccggttggtatgaaacggccaatcacgattgggtgtatattcagagcggtaaagcactgaccggtgagcaaaccatcaatggtcagcacctgtactttaaagaagatggccaccaagttaaaggtcagctggtcacccgtacggacggcaaagtgcgttactatgacgcaaattctggcgatcaagcgttcaacaagtccgtgacggttaacggcaaaacgtattacttcggtaatgatggtaccgcgcaaaccgcgggtaacccgaaaggccaaatcttcaaggacggcagcgttctgcgtttctatagcatggaaggccagctggtaattggcagcggctggtattccaacgcgcaaggccaatggctgtatgtgaagaatggtaaagtgttgaccggtttgcagaccgtcggttcccagcgcgtgtactttgatgagaatggcattcaagcaaaaggcaaagcggttcgcacgagcgacggcaaaattcgctacttcgacgagaacagcggtagcatgatcaccaatcaatggaagtttgtttacggtcaatactattactttggtaatgacggtgcggcaatctaccgtggttggaattaa

SEQ ID NO: 26 - protein, 1435 aa, Streptococcus sobrinus
MVDGKYYYYDQDGNVKKNFAVSVGDKIYYFDETGAYKDTSKVDADKSSSAVSQNATIFAANNRAYSTSAENFEAVDNYLTADSWYRPKSILKDGKTWTESGKDDFRPLLMAWWPDTETKRNYVNYMNLVVGIDKTYTAETSQADLTAAAELVQARIEQKITTEQNTKWLREAISAFVKTQPQWNGESEKPYDDHLQNGALKFDNQSDLTPDTQSNYRLLNRTPTNQTGSLDSRFTYNANDPLGGYEFLLANDVDNSNPVVQAEQLNWLHYLLNFGSIYAKDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDIIRDIIKAEINPNSFGYSFTQEEIDQAFKIYNEDLKKTDKKYTHYNVPLSYTLLLTNKGSIPRVYYGDMFTDDGQYMANKTVNYDAIESLLKARMKYVSGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQVSNKYFNVASDTLFLPSSLLGKVVESGIRYDGKGYIYNSSATGDQVKASFITEAGNLYYFGKDGYMVTGAQTINGANYFFLENGTALRNTIYTDAQGNSHYYANDGKRYENGYQQFGNDWRYFKDGNMAVGLTTVDGNVQYFDKDGVQAKDKIIVTRDGKVRYFDQHNGNAVTNTFIADKTGHWYYLGKDGVAVTGAQTVGKQKLYFEANGEQVKGDFVTSHEGKLYFYDVDSGDMWTDTFIEDKAGNWFYLGKDGAAVSGAQTIRGQKLYFKAYGQQVKGDIVKGTDGKIRYYDAKSGEQVFNKTVKAADGKTYVIGNNGVAVDPSVVKGQTFKDASGALRFYNLKGQLVTGSGWYETANHDWVYIQSGKALTGEQTINGQHLYFKEDGHQVKGQLVTRTDGKVRYYDANSGDQAFNKSVTVNGKTYYFGNDGTAQTAGNPKGQIFKDGSVLRFYSMEGQLVIGSGWYSNAQGQWLYVKNGKVLTGLQTVGSQRVYFDENGIQAKGKAVRTSDGKIRYFDENSGSMITNQWKFVYGQYYYFGNDGAAIYRGWN

SEQ ID NO: 27 - DNA, 4023 bp, Streptococcus salivarius PS4
atgattgacggcaaatactactacgtaaacaaagatggctcgcacaaagagaatttcgcaattaccgtgaatggtcagttgttgtatttcggtaaggacggtgcattgacgtctagcagcacctacagctttacgcagggcaccaccaacatcgttgatggctttagcaaaaacaaccgtgcgtacgattccagcgaggcgagctttgaactgatcgacggttatctgaccgcggactcctggtatcgtccggtgagcattatcaaggacggcgttacgtggcaagccagcaccaaagaggactttcgcccgctgctgatggcctggtggccgaatgttgacacccaggtcaactacctgaattacatgtcgaaggtgtttaacctggacgcgaagtatacgagcaccgacaaacaggttgacctgaatcgcgcagccaaggacattcaggttaagattgagcaaaagattcaggccgagaagagcactcaatggctgcgtgaagcgatttcggccttcgtcaaaacccagccgcagtggaataaagaaacggagaacttctccaagggtggtggtgaggatcatctgcaaggtggtgcactgctgtacgttaacgacccgcgtaccccgtgggctaactccaactaccgcctgctgaatcgtactgcgaccaaccagaccggcacgatcgacaagagcgttctggacgaacagagcgatcctaaccacatgggcggcttcgattttctgctggcgaatgacgtcgataccagcaatccggtggtgcaggcggaacaactgaatcagatccactacctgatgaattggggttccattgttatgggcgacaaagatgcaaacttcgatggtatccgcgtggacgcggtcgataacgttgacgcagatatgctgcaactgtacaccaactactttcgtgagtattatggcgtgaacaaaagcgaggcaaacgctttggcgcacatctcggtgctggaagcgtggagcttgaatgataatcactataatgacaagactgacggtgcggccctggcgatggagaacaaacagcgtttggccctgctgtttagcttggcgaaaccgatcaaagaacgtacccctgcggtgagcccgctgtacaacaacactttcaacacgacgcagcgtgacgaaaagaccgattggattaacaaagacggtagcaaagcctataatgaggacggcaccgtcaagcagtccaccatcggcaagtacaacgagaaatacggcgacgcgtccggcaattatgtgttcattcgcgcccacgataacaacgtccaagacattattgcagagatcattaagaaagaaatcaatccgaaaagcgacggtttcaccattaccgacgccgaaatgaaaaaggcattcgaaatctacaacaaagatatgctgtcctctgataagaaatacaccctgaacaacatcccagcggcctacgcggtgatgctgcaaaacatggaaaccattactcgtgtgtattacggcgatctgtataccgacgatggccattacatggaaaccaagagcccgtactacgacaccattgtgaacctgatgaagaaccgtatcaaatacgtgtccggtggtcaagcgcaacgttcctattggctgccgaccgacggtaagatggataaaagcgatgtcgaactgtatcgcaccaacgaggtgtacaccagcgtccgttacggtaaggacatcatgactgccgatgacacccaaggtagcaagtacagccgtaccagcggtcaggtgaccctggtggtgaacaacccgaagctgtctttggataagagcgcgaagctggacgtcgaaatgggcaagatccatgcaaaccagaaataccgtgctctgatcgtgggtacgccgaacggcatcaaaaacttcacgagcgacgccgaggcaatcgcggctggctacgtgaaagaaaccgacggcaatggtgtgctgaccttcggtgcaaatgacatcaaaggttacgaaacgtttgacatgagcggtttcgttgcagtttgggttccggtaggtgcaagcgatgatcaagacatccgtgtcgccgcaagcaccgcggcaaagaaagaaggtgagctgactttgaaggcaactgaggcgtatgactctcagctgatttacgaaggtttttcgaattttcagaccattccggatggtagcgatccgagcgtttacaccaatcgtaagatcgcggaaaatgttgatttgttcaagagctggggtgtgacctctttcgaaatggcgccacagtttgtgagcgcagacgacggtacgtttctggacagcgttatccagaacggctatgcgtttgcggaccgttatgatctggcgatgtccaaaaacaataagtacggttcgaaagaagatctgcgtaacgcgttgaaggctttgcacaaggccggcatccaagccattgcggactgggttccggatcagatctaccaactgccgggcaaagaagtagtgaccgccactcgtaccgatggtgccggtcgtaagattagcgatgcaattatcgatcacagcctgtacgtcgcaaacagcaagtcgtctggcaaagactatcaagctaaatacggtggtgagttcctggccgagctgaaagcaaagtacccggaaatgtttaaagtcaacatgattagcacgggtaaaccgatcgacgactctgtcaaactgaagcaatggaaggcggagtactttaacggtacgaatgttctggaccgtggtgttggttacgtcctgagcgatgaggcgacgggcaagtactttaccgttacgaaagagggtaactttatcccactgcaattgaaaggtaacgagaaagttatcacgggcttcagctctgacggcaagggcattacctatttcggcacctcgggtaatcaagcgaaaagcgcttttgtcacgttcaatggtaatacctactattttgacgcgcgtggccacatggttaccaacggcgaatatagccctaatggtaaggatgtgtatcgtttcctgccgaatggtattatgttgagcaatgcattctacgttgacggtaacggcaatacctacctgtacaactccaagggccaaatgtacaaaggtggttatagcaaattcgacgttacggaaaccaaagatggtaaagagagcaaagtggtgaaatttcgctactttaccaatgaaggtgtgatggcaaaaggtgttaccgtggtggacggcttcactcaatacttcaacgaagatggcattcagagcaaggacgaactggtgacctacaatggtaaaacctattacttcgaagcgcataccggtaatgcgatcaaaaacacgtggcgcaatatcaagggtaagtggtatcactttgatgcgaatggcgtggcggcaacgggtgcacaggttatcaatggtcagcacctgtactttaatgaggatggttcccaggtgaagggtggcgtcgtgaagaatgcggatggtaccttcagcaagtataaagatggttccggtgacctggtggtcaatgagttcttcactactggtgataacgtgtggtactacgctggtgccaacggcaaaactgtgacgggtgcccaggtcatcaatggccaacacctgtttttcaaagaggacggtagccaggttaagggtgatttcgttaagaacagcgacggcacctactctaagtatgatgcggccagcggcgaacgcctgacgaatgagtttttcacgaccggtgacaaccactggtactatattggtgccaatggcaaaaccgttaccggcgaagtcaagatcggtgatgatacgtacttcttcgcaaaagatggcaagcagctgaagggccagatcgtgacgacccgcagcggtcgtatcagctactacttcggcgactctggtaagaaggcgattagcacctgggtggagattcagccgggtgttttcgtgtttttcgacaaaaatggcctggcatatccgccggaaaacatgaattaa

SEQ ID NO: 28 - protein, 1340 aa, Streptococcus salivarius PS4
MIDGKYYYVNKDGSHKENFAITVNGQLLYFGKDGALTSSSTYSFTQGTTNIVDGFSKNNRAYDSSEASFELIDGYLTADSWYRPVSIIKDGVTWQASTKEDFRPLLMAWWPNVDTQVNYLNYMSKVFNLDAKYTSTDKQVDLNRAAKDIQVKIEQKIQAEKSTQWLREAISAFVKTQPQWNKETENFSKGGGEDHLQGGALLYVNDPRTPWANSNYRLLNRTATNQTGTIDKSVLDEQSDPNHMGGFDFLLANDVDTSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKKAFEIYNKDMLSSDKKYTLNNIPAAYAVMLQNMETITRVYYGDLYTDDGHYMETKSPYYDTIVNLMKNRIKYVSGGQAQRSYWLPTDGKMDKSDVELYRTNEVYTSVRYGKDIMTADDTQGSKYSRTSGQVTLVVNNPKLSLDKSAKLDVEMGKIHANQKYRALIVGTPNGIKNFTSDAEAIAAGYVKETDGNGVLTFGANDIKGYETFDMSGFVAVWVPVGASDDQDIRVAASTAAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRNALKALHKAGIQAIADWVPDQIYQLPGKEVVTATRTDGAGRKISDAIIDHSLYVANSKSSGKDYQAKYGGEFLAELKAKYPEMFKVNMISTGKPIDDSVKLKQWKAEYFNGTNVLDRGVGYVLSDEATGKYFTVTKEGNFIPLQLKGNEKVITGFSSDGKGITYFGTSGNQAKSAFVTFNGNTYYFDARGHMVTNGEYSPNGKDVYRFLPNGIMLSNAFYVDGNGNTYLYNSKGQMYKGGYSKFDVTETKDGKESKVVKFRYFTNEGVMAKGVTVVDGFTQYFNEDGIQSKDELVTYNGKTYYFEAHTGNAIKNTWRNIKGKWYHFDANGVAATGAQVINGQHLYFNEDGSQVKGGVVKNADGTFSKYKDGSGDLVVNEFFTTGDNVWYYAGANGKTVTGAQVINGQHLFFKEDGSQVKGDFVKNSDGTYSKYDAASGERLTNEFFTTGDNHWYYIGANGKTVTGEVKIGDDTYFFAKDGKQLKGQIVTTRSGRISYYFGDSGKKAISTWVEIQPGVFVFFDKNGLAYPPENMN

SEQ ID NO: 29 - DNA, 4026 bp, Streptococcus salivarius K12
atgacggacggtaaatactattatgtaaatgaggacggcagccacaaagagaatttcgcaattacggtaaacggtcaactgttgtactttggcaaggacggcgctctgacgagcagcagcacgcacagcttcacgccgggtactacgaatattgtggacggtttctcgatcaacaaccgtgcgtacgatagcagcgaagcgagctttgagctgatcaacggttacctgacggcggattcctggtatcgcccggtttctatcatcaaggatggcgtcacgtggcaggcaagcactgccgaggattttcgtccgctgttgatggcctggtggccgaacgttgatacccaggtgaactatctgaactatatgtccaaggtctttaacctggaagccaagtacaccagcaccgataaacaggctgatctgaaccgtgctgcaaaggatatccaggtcaagatcgaacagaagatccaggcggaaaagagcacgcagtggctgcgtgagactatctccgcgtttgttaaaacccagccgcaatggaacaaagagactgagaattactccaagggtggtggcgaagatcatctgcaaggcggtgcgctgttgtacgtgaacgacagccgtaccccgtgggcgaatagcaattaccgcctgctgaatcgcacggcaacgaaccagaccggtaccattaacaagtcggtgttggacgagcaatccgatccaaatcacatgggtggcttcgacttcctgctggcaaacgatgtggatctgagcaatcctgttgtgcaggccgagcagctgaatcaaatccattatctgatgaactggggcagcattgttatgggtgacaaagacgcgaattttgatggtatccgtgtggacgccgttgacaacgtgaacgctgacatgttgcagctgtacacgaactactttcgtgagtattacggcgtcaacaaaagcgaagcgcaagcgctggcgcacattagcgttctggaagcgtggagcttgaacgataaccactataacgacaaaaccgatggtgcggcactggcgatggagaataagcaacgtctggccttgctgttctctctggccaagccgatcaaagatcgtactccggcagtgagcccactgtataacaatactttcaataccacccaacgtgacttcaagacggattggattaacaaggacggtagcaccgcctacaatgaggatggcaccgcgaaacaatctaccatcggtaagtacaatgagaaatatggtgatgcaagcggtaactatgtgtttattcgtgcccatgacaataacgtccaagacattattgcggagatcattaagaaagaaatcaataagaagagcgatggttttaccatcagcgatagcgaaatgaaacaggcgttcgaaatctacaacaaagatatgctgagcagcaataagaaatacactctgaataacattccggcagcgtacgccgtgatgctgcaaaacatggagactatcacccgtgtgtattatggtgacctgtacaccgacgacggtcactatatggaaaccaagagcccgtatcatgacaccattgtgaacctgatgaaaaaccgtatcaagtacgtttctggtggccaggcccaacgctcctattggctgccgaccgacggtaaaatggacaatagcgatgtcgaactgtaccgtactagcgaggtctataccagcgttcgctacggtaaggacattatgacggcggatgacaccgagggtagcaagtactcccgcacgagcggtcaggttaccctggttgttaacaacccgaagctgactctgcatgaaagcgccaaactgaacgtcgagatgggtaagatccacgcaaaccagaaataccgtgcgctgattgtgggtaccgccgatggcatcaaaaactttacgtctgatgccgaagcgatcgcggcaggctacgtaaaagaaacggacagcaatggtgttctgaccttcggcgcaaatgatatcaaaggttacgagactttcgatatgagcggtttcgtcgcagtttgggtgccggtgggtgcgagcgatgatcaggacatccgcgtggcgccgtcgacggaagcgaagaaagaaggtgaactgacgctgaaagccacggaagcgtatgatagccagttgatttatgaaggcttctccaatttccagaccattccggatggcagcgacccgagcgtttataccaaccgcaaaattgctgagaatgttgatctgtttaagtcctggggtgtcactagcttcgaaatggctccgcagtttgtttcggcggacgacggcaccttcctggatagcgttatccagaacggttacgcctttgcggaccgttatgatttggccatgagcaagaacaacaagtacggttctaaagaggatctgcgcgacgcactgaaagcgctgcacaaagctggcattcaggcaatcgcggactgggtcccagaccaaatctaccaactgccaggcaaagaagtggttacggcgacgcgcacggacggtgcgggtcgcaagatcgcggacgccatcattgatcatagcctgtatgttgctaactccaagagctccggtcgcgattaccaagcgcagtatggtggcgagtttctggcagagctgaaagcgaagtacccgaaaatgttcacggaaaacatgattagcacgggtaagccgatcgatgacagcgtcaaactgaagcaatggaaagccaagtatttcaatggtacgaatgtgctggaccgtggtgtcggttacgtcctgtccgacgaggcgaccggcaaatacttcaccgttaccaaagagggtaacttcattccgctgcaactgaccggcaatgaaaaagcggtgaccggtttcagcaacgacggcaagggtatcacctactttggtacgagcggtaatcaggccaagagcgcgttcgtcacctttaacggcaatacgtactatttcgacgcgcgtggccacatggtcacgaacggcgagtatagcccgaacggcaaagatgtctaccgttttctgccaaatggtattatgttgtcgaacgcgttttatgtcgacgcaaacggtaatacgtacttgtacaactacaagggccagatgtacaaaggtggttatacgaaatttgatgtcaccgaaactgataaagatggtaatgagagcaaggtggtcaagtttcgttatttcaccaatgagggcgtcatggctaagggtctgaccgtcattgacggtagcacccagtactttggtgaggatggttttcaaacgaaggacaagctggcgacctataaaggtaagacttattacttcgaggcacacacgggcaatgcgatcaaaaacacctggcgtaacatcgacggtaagtggtatcacttcgatgagaatggcgttgccgcgaccggtgcacaagtgattaacggtcaaaaactgtatttcaacgaggatggctcgcaagtgaagggcggtgttgttaagaacgccgacggtacctacagcaaatacaaagagggcagcggtgagctggttaccaacgagtttttcacgaccgacggtaatgtgtggtactatgctggtgcggatggcaagactgtgaccggtgctcaggtcattaatggtcagcacctgtactttaaagaagatggcagccaggtgaaaggtggtgtggtgaaaaacgcggacggtacgtacagcaagtatgacgccgccaccggtgaacgcttgaccaatgagttctttaccacgggcgataacaattggtactatattggttctaatggtaagaccgtaaccggtgaagtcaaaatcggtgcggacacctattactttgccaaagatggcaaacaggtcaagggccaaaccgtcaccgcaggcaatggccgcatctcctattactacggcgattctggtaagaaagcaatcagcacgtggatcgaaattcaaccgggtatctatgtctattttgataagacgggcatcgcgtacccaccgcgtgtgctgaattaa

SEQ ID NO: 30 - protein, 1341 aa, Streptococcus salivarius K12
MTDGKYYYVNEDGSHKENFAITVNGQLLYFGKDGALTSSSTHSFTPGTTNIVDGFSINNRAYDSSEASFELINGYLTADSWYRPVSIIKDGVTWQASTAEDFRPLLMAWWPNVDTQVNYLNYMSKVFNLEAKYTSTDKQADLNRAAKDIQVKIEQKIQAEKSTQWLRETISAFVKTQPQWNKETENYSKGGGEDHLQGGALLYVNDSRTPWANSNYRLLNRTATNQTGTINKSVLDEQSDPNHMGGFDFLLANDVDLSNPVVQAEQLNQIHYLMNWGSIVMGDKDANFDGIRVDAVDNVNADMLQLYTNYFREYYGVNKSEAQALAHISVLEAWSLNDNHYNDKTDGAALAMENKQRLALLFSLAKPIKDRTPAVSPLYNNTFNTTQRDFKTDWINKDGSTAYNEDGTAKQSTIGKYNEKYGDASGNYVFIRAHDNNVQDIIAEIIKKEINKKSDGFTISDSEMKQAFEIYNKDMLSSNKKYTLNNIPAAYAVMLQNMETITRVYYGDLYTDDGHYMETKSPYHDTIVNLMKNRIKYVSGGQAQRSYWLPTDGKMDNSDVELYRTSEVYTSVRYGKDIMTADDTEGSKYSRTSGQVTLVVNNPKLTLHESAKLNVEMGKIHANQKYRALIVGTADGIKNFTSDAEAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGRDYQAQYGGEFLAELKAKYPKMFTENMISTGKPIDDSVKLKQWKAKYFNGTNVLDRGVGYVLSDEATGKYFTVTKEGNFIPLQLTGNEKAVTGFSNDGKGITYFGTSGNQAKSAFVTFNGNTYYFDARGHMVTNGEYSPNGKDVYRFLPNGIMLSNAFYVDANGNTYLYNYKGQMYKGGYTKFDVTETDKDGNESKVVKFRYFTNEGVMAKGLTVIDGSTQYFGEDGFQTKDKLATYKGKTYYFEAHTGNAIKNTWRNIDGKWYHFDENGVAATGAQVINGQKLYFNEDGSQVKGGVVKNADGTYSKYKEGSGELVTNEFFTTDGNVWYYAGADGKTVTGAQVINGQHLYFKEDGSQVKGGVVKNADGTYSKYDAATGERLTNEFFTTGDNNWYYIGSNGKTVTGEVKIGADTYYFAKDGKQVKGQTVTAGNGRISYYYGDSGKKAISTWIEIQPGIYVYFDKTGIAYPPRVLN

SEQ ID NO: 31 - DNA, 3918 bp, Streptococcus salivarius
atgatcgacggcaaacagtattatgtagagaacggtgtggttaagaaaaatgcggcaattgaactggatggccgcctgtactactttgatgagactggcgcaatggtcgatcagagcaaaccgttgtatcgtgcggacgcgattccgaacaactctatctacgccgtgtacaaccaagcgtatgataccagcagcaaatccttcgagcatttggataacttcctgaccgcggatagctggtatcgcccgaaacagattctgaaggacggtaaaaactggaccgcaagcactgagaaagactatcgtcctctgctgatgacctggtggccggacaaggtgacccaggtgaattacctgaactatatgtctcaacagggttttggtaacaaaacgtacaccacggatatgatgagctacgacctggcggctgcggcagaaacggtgcagcgtggcatcgaagagcgtatcggtcgcgagggtaacaccacgtggctgcgccagctgatgagcgatttcatcaaaacccagccgggttggaatagcgagagcgaggacaatctgctggttggtaaggaccatctgcaaggtggtgcgctgacctttctgaacaatagcgcaacgagccacgcgaatagcgactttcgtctgatgaaccgtaccccgaccaatcagaccggtacccgtaaataccacatcgatcgtagcaatggcggctatgagctgctgctggctaacgacattgataatagcaatccggcagttcaagcagagcaactgaattggctgcactacattatgaatattggcagcatcttgggtaatgacccgagcgcgaattttgacggtgttcgtatcgatgcggtggataatgtggacgcggatttgctgcaaatcgcgtctgattacttcaaagagaagtaccgtgtcgcggacaacgaggcaaacgcgattgcccacctgagcattctggaagcgtggagctataatgatcatcagtacaacaaggacacgaagggcgcacagctgtccatcgataacccgctgcgcgaaaccctgctgactaccttcctgcgtaaaagcaattatcgtggtagcttggagcgcgttattaccaactccctgaataaccgctctagcgagcaaaagcacactccgcgcgacgcgaactacatctttgtacgtgcgcatgacagcgaagttcaagacgtgctggcgaatatcattagcaaacagatcaacccaaagacggatggcttcacgttcaccatggatgaactgaagcaggcgttcgagatctacaatgcggatattgcgaaggcggacaagaagtatacccaatacaacattccggcagcttacgcaaccatgctgacgaacaaggatagcattacccgcgtttactacggcgacctgtttacggatgacggtcagtatatggccgagaaatccccgtactataacgcaattgacgctctgctgcgtgcgcgcattaagtacgtcgcgggtggtcaggacatgaaggtgactaaactgaatggttatgagattatgagcagcgtgcgttatggtaaaggtgcagaagaggctaaccagctgggtacggcagaaacccgcaatcaaggtatgctggttctgacggctaaccgtccggacatgaaactgggtgcaaacgatcgcctggtcgtgaatatgggcgctgcccacaaaaaccaggcctaccgcccgttgctgttgtccaaatctactggcctggcgacgtatctgaaagatagcgacgttccggcaggcctggtgcgttataccgataaccagggtaatctgacctttacggcggacgatattgcaggccatagcacggttgaagtgagcggttacttggcggtctgggttccggtcggcgcgagcgagaaccaggacgcgcgcacgaaggccagctctaccaagaagggcgagcaagttttcgaatctagcgccgctctggacagccaggttatctacgaaggtttctccaatttccaagattttgtcaagaccccgagccagtacaccaaccgcgtgatcgcgcaaaatgcgaagctgtttaaagaatggggcatcactagctttgagttcgcgcctcagtatgtttctagccaagacggcacctttttggatagcatcattgaaaacggctacgcgttcgaggatcgttacgatatcgcaatgagcaagaacaataagtatggcagcctgaaagatttgatggacgcactgcgtgcgttgcatgcggaaggcatcagcgcaatcgccgattgggtcccggaccaaatctataatctgccgggtaaagaagttgtcacggcgagccgtaccaacagctatggtaccccgcgtccgaatgcggaaatctacaatagcctgtacgctgctaaaacgcgcacgttcggtaatgacttccagggtaagtatggtggcgcatttctggacgaactgaaagcaaagtacccggccatctttgagcgtgttcaaatcagcaacggtcgtaaattgaccacgaatgagaagattacccagtggagcgccaaatactttaatggtagcaatattcagggcacgggtgcgcgttacgttttgcaggacaacgctaccaatcagtactttagcgttaaggcgggtcagactttcctgccgaagcagatgaccgaaattaccggcagcggtttccgtcgtgtcggtgacgatgtccaatatctgagcattggtggttatctggcgaagaatacctttatccaggtcggtgcgaatcagtggtattattttgacaaaaacggcaatatggttacgggtgaacaggtgatcgatggtaaaaagtacttcttcttggataacggtctgcaactgcgtcatgttctgcgccagggctccgatggtcacgtctattactatgaccctaaaggtgtgcaagcgttcaatggtttctacgactttgcaggccctcgccaagacgttcgttacttcgatggcaatggtcagatgtatcgcggcctgcacgatatgtacggtacgaccttttacttcgacgagaaaaccggcatccaagcaaaagacaagttcattcgcttcgcagacggtcgtacccgttacttcattccggacaccggtaatctggcagtgaatcgtttcgcccaaaacccggagaacaaagcctggtattacctggatagcaacggttacgctgtcaccggcttgcagacgattaatggcaagcagtattactttgacaacgaaggccgtcaggttaaaggccactttgtgaccattaacaaccagcgttactttctggatggtgactcgggcgagatcgcgccatcgcgtttcgttaccgagaacaacaagtggtactacgtcgacggtaatggtaagctggtcaagggtgcacaggtgattaacggtaaccactactacttcaataacgactatagccaggtgaagggtgcatgggcgaacggtcgttactacgatggcgacagcggtcaagcggtcagcaaccagtttattcaaattgcggcgaaccaatgggcatatctgaatcaagatggccacaaggtcacgggtctgcaaaacatcaacaataaagtgtactattttggctctaatggcgcgcaagttaagggtaaactgctgaccgtgcaaggcaagaaatgctactttgacgcccacaccggtgagcaagtcgttaatcgcttcgtggaagctgcccgtggttgctggtactatttcaattccgctggccaggccgttaccggccaacaagtcatcaacggtaagcagttgtattttgatggttctggtcgtcaagtcaaaggccgttatgtgtacgtgggtggtaaacgtttgttctgtgatgcgaaaacgggcgagctgcgtcaacgccgttaa

SEQ ID NO: 32 - protein, 1305 aa, Streptococcus salivarius
MIDGKQYYVENGVVKKNAAIELDGRLYYFDETGAMVDQSKPLYRADAIPNNSIYAVYNQAYDTSSKSFEHLDNFLTADSWYRPKQILKDGKNWTASTEKDYRPLLMTWWPDKVTQVNYLNYMSQQGFGNKTYTTDMMSYDLAAAAETVQRGIEERIGREGNTTWLRQLMSDFIKTQPGWNSESEDNLLVGKDHLQGGALTFLNNSATSHANSDFRLMNRTPTNQTGTRKYHIDRSNGGYELLLANDIDNSNPAVQAEQLNWLHYIMNIGSILGNDPSANFDGVRIDAVDNVDADLLQIASDYFKEKYRVADNEANAIAHLSILEAWSYNDHQYNKDTKGAQLSIDNPLRETLLTTFLRKSNYRGSLERVITNSLNNRSSEQKHTPRDANYIFVRAHDSEVQDVLANIISKQINPKTDGFTFTMDELKQAFEIYNADIAKADKKYTQYNIPAAYATMLTNKDSITRVYYGDLFTDDGQYMAEKSPYYNAIDALLRARIKYVAGGQDMKVTKLNGYEIMSSVRYGKGAEEANQLGTAETRNQGMLVLTANRPDMKLGANDRLVVNMGAAHKNQAYRPLLLSKSTGLATYLKDSDVPAGLVRYTDNQGNLTFTADDIAGHSTVEVSGYLAVWVPVGASENQDARTKASSTKKGEQVFESSAALDSQVIYEGFSNFQDFVKTPSQYTNRVIAQNAKLFKEWGITSFEFAPQYVSSQDGTFLDSIIENGYAFEDRYDIAMSKNNKYGSLKDLMDALRALHAEGISAIADWVPDQIYNLPGKEVVTASRTNSYGTPRPNAEIYNSLYAAKTRTFGNDFQGKYGGAFLDELKAKYPAIFERVQISNGRKLTTNEKITQWSAKYFNGSNIQGTGARYVLQDNATNQYFSVKAGQTFLPKQMTEITGSGFRRVGDDVQYLSIGGYLAKNTFIQVGANQWYYFDKNGNMVTGEQVIDGKKYFFLDNGLQLRHVLRQGSDGHVYYYDPKGVQAFNGFYDFAGPRQDVRYFDGNGQMYRGLHDMYGTTFYFDEKTGIQAKDKFIRFADGRTRYFIPDTGNLAVNRFAQNPENKAWYYLDSNGYAVTGLQTINGKQYYFDNEGRQVKGHFVTINNQRYFLDGDSGEIAPSRFVTENNKWYYVDGNGKLVKGAQVINGNHYYFNNDYSQVKGAWANGRYYDGDSGQAVSNQFIQIAANQWAYLNQDGHKVTGLQNINNKVYYFGSNGAQVKGKLLTVQGKKCYFDAHTGEQVVNRFVEAARGCWYYFNSAGQAVTGQQVINGKQLYFDGSGRQVKGRYVYVGGKRLFCDAKTGELRQRR

SEQ ID NO: 33 - DNA, 4026 bp, Streptococcus salivarius JIM8777
atgatcgacggcaaatactactatgtaaacgaggacggcagccacaaagagaatttcgcgattacggtaaacggtcagctgctgtactttggtaaggacggtgctctgacgagcagctccacgtacagctttaccccgggtacgaccaatattgtcgatggcttcagcattaacaaccgtgcgtatgacagcagcgaggcatcctttgagctgatcgatggttatttgaccgcggatagctggtatcgtccggcgagcatcattaaggacggcgttacgtggcaggcctcgaccgcagaagattttcgtccgctgctgatggcttggtggccgaatgttgacacccaggtgaattatctgaattacatgtccaaggttttcaacctggatgcaaagtacaccagcaccgacaagcaggaaaccctgaacgtggctgcgaaagatatccaagtcaagattgagcaaaagattcaggcagagaaatctacccagtggctgcgtgaaacgattagcgcgtttgttaaaactcagccgcaatggaataaagaaacggaaaactattccaagggtggtggcgaggaccatctgcaaggcggtgccctgttgtacgttaacgattcgcgcaccccgtgggcgaactcgaactatcgcttgctgaaccataccgctaccaatcaaaaaggcactattgacaaatctgtcctggacgagcagagcgacccgaaccacatgggcggtttcgattttctgctggcgaacgacgtcgacctgagcaacccggtggtgcaggccgaacaactgaaccagattcactacctgatgaattggggtagcatcgtgatgggtgataaagatgcgaactttgacggcattcgtgtcgatgcggtcgataacgtggacgccgacatgttgcagctgtacacgaactactttcgtgagtactacggcgttaacaagagcgaagcaaatgccctggcgcatatcagcgttctggaagcgtggagcctgaatgacaatcactataacgataagacggacggtgcggccctggcaatggagaataaacaacgtctggcgctgctgttcagcctggcgaaaccgatcaaagagcgtacgccggctgtgagcccactgtataacaacaccttcaatactacgcagcgtgacgagaaaacggactggattaacaaagacggtagcaaagcgtataacgaggatggtaccgtcaagcaatcgaccattggtaagtacaatgagaagtatggcgacgcaagcggtaattacgtgttcattcgtgcccacgacaacaatgttcaagacatcatcgccgaaatcatcaagaaagagatcaaccctaagagcgacggtttcaccatcaccgacgcagagatgaagaaggcctttgaaatctacaacaaggacatgttgagcagcgataagaagtatactctgaacaacattccggctgcgtacgcggtgatgttgcagaatatggaaaccatcacgcgtgtttactatggtgatctgtataccgataatggcaactacatggaaacgaaaagcccgtactatgacaccattgttaatctgatgaagaatcgcatcaagtatgtgtctggcggtcaagcgcagcgttcttactggctgccgaccgatggtaagatggacaatagcgatgtggaactgtaccgcaccaacgaggtatacgcttctgtgcgctatggtaaagacattatgaccgccgatgataccgagggttccaagtactcccgtacgagcggccaagttaccttggtggcaaacaacccgaaattgaccctggaccaaagcgcgaaactgaaagtggagatgggtaagatccacgcaaatcaaaagtaccgtgcactgattgtcggtaccgccgacggtatcaagaatttcaccagcgatgcggatgcgattgcagcaggctatgttaaagagactgatagcaatggtgtgctgacgtttggtgcgaacgacattaaaggctatgaaacgtttgacatgagcggtttcgttgcggtgtgggtgcctgtgggtgctagcgatgatcaggatatccgtgtcgcgccgagcaccgaggcaaagaaagaaggtgagctgacgttgaaagcgaccgaggcctatgacagccagttgatttacgaaggtttcagcaatttccaaaccattccagacggttccgatccgagcgtctacaccaatcgcaaaatcgcggaaaacgttgatctgttcaaaagctggggtgtgaccagcttcgaaatggcaccgcaattcgttagcgcggacgatggtacgttcttggacagcgttatccaaaatggctatgcgttcgccgatcgttatgacttggcgatgagcaaaaacaacaaatacggcagcaaagaggatctgcgcgacgccctgaaagcgctgcataaagcgggtattcaagccatcgctgactgggttccggaccagatctaccagctgccgggtaaagaagtcgttaccgcgacccgcaccgatggcgctggccgtaagatcgcggatgcaattatcgatcatagcttgtatgtggccaatactaaaagctccggtaaggattaccaggcgaaatatggtggtgaatttctggctgagctgaaggccaaatacccggagatgttcaaggtcaacatgattagcaccggcaaacctattgatgactctgtcaaattgaaacaatggaaggcagagtatttcaatggcactaacgtcctggaacgtggtgttggttacgtgctgagcgacgaggcgaccggtaaatacttcaccgttacgaaggacggcaatttcatcccgctgcaactgaccggtaatgagaaggttgtgacgggtttttctaatgacggtaagggcattacctacttcggtacctcgggtacccaggcaaagagcgcattcgtgacgtttaacggtaacacctactactttgatgcacgcggccacatggtgacgaacggcgagtacagcccgaacggcaaggatgtttatcgcttcctgccgaatggcatcatgctgtccaatgcgttttacgtcgatgcaaatggtaatacttacctgtacaacagcaagggtcagatgtataagggcggttataccaagttcgacgttactgaaacggacaaggacggtaaagagagcaaagtagtgaagtttcgttatttcacgaacgaaggcgtcatggcgaaaggtgtcaccgttattgatggctttacccagtatttcggtgaagatggctttcaagcgaaggacaagctggtgacctttaagggcaaaacctactattttgacgcgcacacgggcaacgccatcaagaacacctggcgtaatatcgacggtaagtggtatcattttgatgcgaacggtgtggcggcgaccggcgcacaggtcattaatggtcaaaaactgtactttaatgaggacggtagccaagtcaaaggtggcgtcgtcaagaatgcagatggcacctatagcaaatacaaagagggctccggtgagctggttaccaacgagttctttaccacggatggtaacgtctggtactatgctggtgcgaatggcaagaccgttaccggtgcacaggttatcaacggccagcacctgtacttcaatgcggatggctctcaagtgaagggcggtgtcgtcaaaaacgcggacggtacgtactccaaatacgatgccgcgaccggtgaacgtctgaccaatgagtttttcacgactggtgacaacaattggtactacatcggcgccaacggtaagacggttacgggcgaagtgaaaattggcgacgatacgtactacttcgcaaaagatggtaaacaggtgaaaggtcagacggtttccgctggtaatggccgcatcagctactattacggtgactctggtaaacgtgcggttagcacgtgggttgaaattcaaccgggcgtgtatgtctattttgataagaatggcctggcatatccaccgcgcgttttgaattaa

SEQ ID NO: 34 - protein, 1341 aa, Streptococcus salivarius JIM8777
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYTSTDKQETLNVAAKDIQVKIEQKIQAEKSTQWLRETISAFVKTQPQWNKETENYSKGGGEDHLQGGALLYVNDSRTPWANSNYRLLNHTATNQKGTIDKSVLDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKKAFEIYNKDMLSSDKKYTLNNIPAAYAVMLQNMETITRVYYGDLYTDNGNYMETKSPYYDTIVNLMKNRIKYVSGGQAQRSYWLPTDGKMDNSDVELYRTNEVYASVRYGKDIMTADDTEGSKYSRTSGQVTLVANNPKLTLDQSAKLKVEMGKIHANQKYRALIVGTADGIKNFTSDADAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANTKSSGKDYQAKYGGEFLAELKAKYPEMFKVNMISTGKPIDDSVKLKQWKAEYFNGTNVLERGVGYVLSDEATGKYFTVTKDGNFIPLQLTGNEKVVTGFSNDGKGITYFGTSGTQAKSAFVTFNGNTYYFDARGHMVTNGEYSPNGKDVYRFLPNGIMLSNAFYVDANGNTYLYNSKGQMYKGGYTKFDVTETDKDGKESKVVKFRYFTNEGVMAKGVTVIDGFTQYFGEDGFQAKDKLVTFKGKTYYFDAHTGNAIKNTWRNIDGKWYHFDANGVAATGAQVINGQKLYFNEDGSQVKGGVVKNADGTYSKYKEGSGELVTNEFFTTDGNVWYYAGANGKTVTGAQVINGQHLYFNADGSQVKGGVVKNADGTYSKYDAATGERLTNEFFTTGDNNWYYIGANGKTVTGEVKIGDDTYYFAKDGKQVKGQTVSAGNGRISYYYGDSGKRAVSTWVEIQPGVYVYFDKNGLAYPPRVLN

SEQ ID NO: 35 - DNA, 3996 bp, Streptococcus salivarius SK126
atggtcgacggcaaatactactacgtgaaagaggatggcagctacaaaacgaacttcgcagtttccgtcaacggccaactgctgtatttcggcaaggatggcgcgctgacgtccaccagcacccatagctttacgccaggcactaccaatctggttgatgcgttcagctcccataaccgcgcctacgactccaaaaaggagagcttcgaactggtggatggttatctgacgccgaactcttggtatcgtccggtcactatcctggaaaatggtgaaaaatggcgtgttagcaccgagaaggactttcgcccgttgttgatggcctggtggccggatgtcgacacgcaagttgcctatctgaacaccttttctaaacacttcaacctgaacgcgacgtactctacttctcagagccaaagcgagctgaatgcggcagctaaaaccatccaaatcaaaatcgaacaggagattagcgcgaaaaagagcacggagtggctgcgccaggcaattgagtcctttgtcaaggagcaggatcagtggaacaccacgaccgagaactacaccctggcggatcatttgcagggcggtgcgctgctgtatgtgaacaatgacaagacgccgtgggcgaacagcgactatcgtctgctgaaccgtactccgagcaaccaggacggcagcctgaacggtactggccgttatctgggtggttacgagtttctgctggcgaatgacgtggacaatagcaatccggtggtccaggctgagcagctgaatcaaattcactatctggtcaactggggcagcattgtcatgggtgacaaggacgcgaatttcgacggcattcgtgttgacgccgttgacaatgtggacgccgatctgttgcaggtttacacgaactacttccgtgcggcgtttggtgtggataaaagcgaagcgaacgcactggcccacatcagcattctggaggcgtgggatctgaacgacaatgcgtacaaccagaaacatgacggtgcggccttggcaatggataacaacctgcgttacgcgatcatgggtgcactgtatggtagcggtagctcgctgaaagatctgattaccagcagcctgaccgaccgtacgaataactccaaatatggtgatacccaagcaaactacatcttcgcccgtgctcatgataatctggtccaggacattattcgtgacatcgtgcagaaagagatcaatccgaagagcgacggctacacgatgaccgatgcggagctgaagcgtgcgtttgaaatctacaacgaggatatgaaaaaggccgaaaaacgctacactatcaacaacatcccggcagcgtatgcactgattttgcagaacatggaacaggttactcgtgtgtactacggtgatctgtataccgacaatggtcagtacatggcgaccaaaagcccgtactacgacgcgattacgaccctgctgaaaaatcgtatgaagtatgtgagcggcggtcagagcatgaaagttgacactttcaacggtaaagaaattctgtcgtctgttcgttacggtaaggacatcatgaccgcggaccaaacgaccggtgtcgcagaaaccagcaagcacagcggcatgctgaccctgatcgccaataaccaggatttttctctgggcgatggcaccttgaaagtgaacatgggcaagctgcacgcgaaccaggcgtatcgcccgctgctgctgggcacggataagggcatcgttacctatgaaaatgacgcggctgcggcaggcaaaatcaagtacacggacgcagagggtaatctgaccttcagcggtgacgagatcaagggctatcgcaccgtggacatgcgcggctacctgggtgtgtgggtcccggtcggcgcaccggacaatcaagacattcgcgttaagggtagcgataagaaactggacaagactttcagcgcaaccgaagctctggatagccaggtgatttacgaaggttttagcaactttcaggacttcgtggaaaaagacagccagtacaccaacaagctgattgcggaaaacgcggaactgtttaagagctggggtattactagctttgaaatggcccctcagtttgtcagcgcagacgatcgtaccttcctggatagcgttatccaaaacggttatgcgtttaccgatcgttacgatctggccatgtctaagaataacaagtatggcagcaaagaagatctgcgtgatgcgctgaaggcgctgcacaagcagggcattcaagcaattgccgactgggttccggatcaactgtaccaactgccgggtcaagaggttgtcaccgctacccgtgcaaatagctacggcaccccgaaggccaatgcctacattaacaatacgctgtatgttgccaatagcaagagcagcggtaaagacttccaggctcaatacggtggcgagttcctggatgaattgcagaagaagtacccgcagttgttcgaggatgtgatgatcagcacgggtaaaaagattgacccgagcgtgaaaatcaagcagtggagcgccaaatacatgaatggcaccaacattctgggtcgtggcaaccgttacgttctgtcgaatgacgccaccggtcgctattatcaagtgaccgacaacggcattttcttgccgaagccgctgacggatcagggtggtaagaccggcttctattacgatggtaagggcatggcctatttcgacaattccggctttcaagcgaaaaatgcgttcatcaagtacgcgggtaactactactacttcgataaagagggctatatgctgacgggccgtcaagatattgacagcaagacgtatttctttctgccgaatggtatccaactgcgtgatagcatttaccaacaagatggcaagtactactattttggtagcttcggcgaacaatacaaagacggttatttcgtctttgacgtgccaaaagagggcaccagcgaaaccgaggctaagttccgctacttttctccgacgggtgagatggcagtgggtttgacctatgcgggtggtggtctgcaatactttgatgagaacggtttccaggcgaagggtacgaagtatgttacgccggatggtaagttgtatttcttcgacaagaatagcggcaacgcgtacaccaatcgttgggcggagatcgatggtatttggtacgagtttaatgaccaaggttacgcgcaggcgaagaaaggtgagttttacaccacggatggtagcacgtggttttaccgcgacgcagcaggtaaaaacgttaccggtgccctgaccctggacggtcacgagtattactttcgtgcgaacggtgcgcaggtgaaaggcgagttcgtcaccgaaaacggtaagattagctattacaccgttgataacggttacaaggtaaaagacaagttcttcgaagtcaatggtaagtggtatcacgctgataaggacggtaatttggcgacgggtcgtcagaccatcgaccatctgaattactacttcaacgcggacggctcccaggttaagtccgatttcttcactctggatggtggtaaaacctggtattatgccaaagacaacggtgagattgtgaccggtgcgtactcggtgcgtggcaagaactattacttcaaagaggacggtagccaagttaagggcgatttcgtcaaaaatgcggacggttccctgagctattatgacaaggatagcggcgaacgtctgaacaaccgtttcttgaccacgggtaacaatgtctggtattactttaaggatggtaaagcggtcacgggtcgccagaacatcgacggtaaggagtactactttgatcacctgggtcgtcaagtcaaaggctccccgattagcactccgaagggcgttgagtattatgagtctgtgctgggtgagcgtgtcaccaacacctggatcaccttccaagacggcaaaaccgtgttctttgatgaaaatggctacgcggactttgataagtaa

SEQ ID NO: 36 - protein, 1331 aa, Streptococcus salivarius SK126
MVDGKYYYVKEDGSYKTNFAVSVNGQLLYFGKDGALTSTSTHSFTPGTTNLVDAFSSHNRAYDSKKESFELVDGYLTPNSWYRPVTILENGEKWRVSTEKDFRPLLMAWWPDVDTQVAYLNTFSKHFNLNATYSTSQSQSELNAAAKTIQIKIEQEISAKKSTEWLRQAIESFVKEQDQWNTTTENYTLADHLQGGALLYVNNDKTPWANSDYRLLNRTPSNQDGSLNGTGRYLGGYEFLLANDVDNSNPVVQAEQLNQIHYLVNWGSIVMGDKDANFDGIRVDAVDNVDADLLQVYTNYFRAAFGVDKSEANALAHISILEAWDLNDNAYNQKHDGAALAMDNNLRYAIMGALYGSGSSLKDLITSSLTDRTNNSKYGDTQANYIFARAHDNLVQDIIRDIVQKEINPKSDGYTMTDAELKRAFEIYNEDMKKAEKRYTINNIPAAYALILQNMEQVTRVYYGDLYTDNGQYMATKSPYYDAITTLLKNRMKYVSGGQSMKVDTFNGKEILSSVRYGKDIMTADQTTGVAETSKHSGMLTLIANNQDFSLGDGTLKVNMGKLHANQAYRPLLLGTDKGIVTYENDAAAAGKIKYTDAEGNLTFSGDEIKGYRTVDMRGYLGVWVPVGAPDNQDIRVKGSDKKLDKTFSATEALDSQVIYEGFSNFQDFVEKDSQYTNKLIAENAELFKSWGITSFEMAPQFVSADDRTFLDSVIQNGYAFTDRYDLAMSKNNKYGSKEDLRDALKALHKQGIQAIADWVPDQLYQLPGQEVVTATRANSYGTPKANAYINNTLYVANSKSSGKDFQAQYGGEFLDELQKKYPQLFEDVMISTGKKIDPSVKIKQWSAKYMNGTNILGRGNRYVLSNDATGRYYQVTDNGIFLPKPLTDQGGKTGFYYDGKGMAYFDNSGFQAKNAFIKYAGNYYYFDKEGYMLTGRQDIDSKTYFFLPNGIQLRDSIYQQDGKYYYFGSFGEQYKDGYFVFDVPKEGTSETEAKFRYFSPTGEMAVGLTYAGGGLQYFDENGFQAKGTKYVTPDGKLYFFDKNSGNAYTNRWAEIDGIWYEFNDQGYAQAKKGEFYTTDGSTWFYRDAAGKNVTGALTLDGHEYYFRANGAQVKGEFVTENGKISYYTVDNGYKVKDKFFEVNGKWYHADKDGNLATGRQTIDHLNYYFNADGSQVKSDFFTLDGGKTWYYAKDNGEIVTGAYSVRGKNYYFKEDGSQVKGDFVKNADGSLSYYDKDSGERLNNRFLTTGNNVWYYFKDGKAVTGRQNIDGKEYYFDHLGRQVKGSPISTPKGVEYYESVLGERVTNTWITFQDGKTVFFDENGYADFDK

SEQ ID NO: 37 - DNA, 3918 bp, Streptococcus salivarius SK126
atgattgacggcaaacagtattatgtagagaacggtgtggttaagaagaatacggcgattgaactggatggccgtctgtattactttgacgaaaccggtgcaatggttgatcaatctaagccgctgtatcgcgcggatgcaatcccgaacaactctatctacgcagtttacaaccaggcttacgacaccagcagcaagagctttgaacacctggacaactttctgacggccgatagctggtaccgtccgaagcagattttgaaagacggcaagaattggaccgcctcgacggagaaggactatcgtcctttgctgatgacgtggtggccggataaagtcacgcaagtcaactacctgaactatatgtcccaacagggctttggtaacaagacctacaccacggatatgatgagctacgacctggcggcagcggcggaaacggttcagcgtggcatcgaagagcgtattggtcgtgagggtaatacgacgtggctgcgtcagttgatgagcgacttcatcaaaacccagccgggctggaatagcgagagcgaagataatctgctggtcggtaaggatcatctgcaaggtggtgcactgacgtttctgaacaatagcaccacgagccatgcgaacagcgatttccgcctgatgaatcgtaccccgacgaaccagaccggcacccgcaaataccacatcgatcgtagcaatggtggctacgaactgctgctggcgaacgacatcgacaatagcaatccggccgtccaagcggaacagctgaactggctgcattacatcatgaacatcggctctatcctgggcaatgacccaagcgcgaattttgatggcgtccgtatcgatgcagttgacaatgtggatgcggacttgttgcaaattgcgtctgactactttaaggaaaagtaccgtgttgccgataacgaggcaaacgctattgcgcacctgtcgattctggaggcatggtcctacaatgatcatcaatacaacaaagacacgaagggcgctcaactgagcattgataatccgctgcgtgagactttgctgacgaccttcctgcgcaagtctaactaccgtggttccctggagcgtgtgatcaccaactcgttgaacaaccgtagcagcgaacagaagcacacgccgcgtgacgccaactacatttttgtgcgtgctcacgacagcgaagttcaagcggtgctggcaaacatcatctctaaacagatcaacccgaaaaccgacggttttacctttacgatggatgagctgaagcaggcgtttgagatttacaacgcagacatgcgtaaggcggataagaagtacacgcagtacaacattccggcagcttacgccaccatgctgaccaataaggatagcatcacccgtgtgtactatggtgatttgtttaccgacgacggtcaatacatggcggagaaaagcccgtactataacgcaattgacgccctgctgcgtgctcgcatcaaatacgtcgcgggtggtcaggacatgaaggtgaccaaattgaacggctatgagatcatgtcctccgttcgctacggtaaaggcgcagaggaagctaatcagctgggcaccgcagaaacccgcaatcaaggcatgctggtcctgaccgcgaatcgcccagacatgaagctgggtacgaatgatcgcctggtcgtcaatatgggtgcagcccacaagaatcaggcgtatcgtccgctgctgctgtccaagtccaccggcttggcaacctacctgaaagacagcgacgtccctgcgggcctggtgcgttacacggacaatcaaggtaatctgaccttcacggcggacgacatcaccggccatagcaccgtagaggtgagcggttacctggcggtttgggtgccggtgggtgcgagcgagaaccaagatgcgcgcacgaaagcgagcacgacgaaaaagggcgaacaagtttttgaaagctccgcagcgctggatagccaggtcatctatgagggtttctccaacttccaggattttgttaagaccccttcccagtacacgaatcgcgttatcgcacagaacgcgaagcgctttaaggagtggggtatcaccagctttgagttcgcgcctcaatatgttagcagccaagacggtacctttctggatagcattattgagaacggctacgcgttcgaggaccgttacgatatcgcgatgagcaaaaacaacaagtacggcagcctgaaggatctgatggacgcgctgcgtgcactgcacgcggagggtatcagcgccattgctgactgggttccggaccaaatctataacctgccgggtaaggaagttgtaaccgcaagccgcacgaatagctacggtacgccgcgtccgaacgcggaaatctataacagcctgtatgcggcgaaaacgcgtacgtttggcaatgattttcagggtaaatacggtggcgcgtttctggatgaactgaaagcaaagtacccggcgatcttcgagcgtgtgcaaatttcgaatggtcgtaagctgactaccaatgagaaaatcacgcaatggagcgcgaagtactttaatggcagcaacattcaaggtaccggtgcgcgttacgttctgcaagataatgccacgaaccagtatttcaacctgaaggccggtcaaacctttctgccaaagcagatgaccgagattaccgcaacgggcttccgtcgtgtcggtgacaaagtgcaatacctgtccacgtccggctacctggcgaagaatacctttatccagattggtgcgaaccagtggtattacttcgacaagaatggcaacatggtgaccggtgagcaagtgattgatggtaaaaagtatttcttcctggataacggtctgcaactgcgtcatgtcttgcgtcaaggttctgacggtcacgtgtattactacgatccgaaaggcgtccaggcgtttaatggtttctatgactttgcgggtccgcgccaagatgtccgttatttcgacggtaatggtcagatgtaccgtggtctgcatgatatgtatggtaccacgttctactttgatgaaaagacgggtatccaggctaaggataagtttatccgtttcgccgacggccgtacccgttactttattccggacaccggcaatttggctgtgaatcgcttcgctcagaatccggaaaacaaggcgtggtactacctggacagcaacggttatgcagtgacgggtttgcagaccattaatggcaaacaatactatttcgacaacgagggccgtcaggtcaagggccacttcgttactatcaacaatcagcgctacttcttggacggtgactcgggtgagatcgcacgtagccgcttcgtgacggagaacaacaaatggtactatgtggatggtaacggtaaattggtcaagggtgcacaagtcatcaacggtaaccactattacttcaataatgattattctcaggtgaaaggtgcttgggccaatggccgctactacgacggcgatagcggccaggcggtcacgaatcgtttcgtgcaggtcggtgcaaaccagtgggcctatctgaatcagaacggtcagaaggttgtgggcttgcaacacatcaatggcaagctgtactactttgaaggcaacggtgtccaagcaaaaggcaagctgctgacctataagggtaagaaatactacttcgatgctaacagcggtgaggcagtcaccaaccgctttattcaaatctctcgcggtgtttggtactatttcaatgcgagcggtcaagcagtgaccggcgagcaagttatcaatggtcaacacctgtacttcgacgcaagcggtcgccaggttaaaggccgctatgtctggattaaaggccagcgccgttattacgacgcgaacactggtgcctgggtacgtaatcgttaa

SEQ ID NO: 38 - protein, 1305 aa, Streptococcus salivarius SK126
MIDGKQYYVENGVVKKNTAIELDGRLYYFDETGAMVDQSKPLYRADAIPNNSIYAVYNQAYDTSSKSFEHLDNFLTADSWYRPKQILKDGKNWTASTEKDYRPLLMTWWPDKVTQVNYLNYMSQQGFGNKTYTTDMMSYDLAAAAETVQRGIEERIGREGNTTWLRQLMSDFIKTQPGWNSESEDNLLVGKDHLQGGALTFLNNSTTSHANSDFRLMNRTPTNQTGTRKYHIDRSNGGYELLLANDIDNSNPAVQAEQLNWLHYIMNIGSILGNDPSANFDGVRIDAVDNVDADLLQIASDYFKEKYRVADNEANAIAHLSILEAWSYNDHQYNKDTKGAQLSIDNPLRETLLTTFLRKSNYRGSLERVITNSLNNRSSEQKHTPRDANYIFVRAHDSEVQAVLANIISKQINPKTDGFTFTMDELKQAFEIYNADMRKADKKYTQYNIPAAYATMLTNKDSITRVYYGDLFTDDGQYMAEKSPYYNAIDALLRARIKYVAGGQDMKVTKLNGYEIMSSVRYGKGAEEANQLGTAETRNQGMLVLTANRPDMKLGTNDRLVVNMGAAHKNQAYRPLLLSKSTGLATYLKDSDVPAGLVRYTDNQGNLTFTADDITGHSTVEVSGYLAVWVPVGASENQDARTKASTTKKGEQVFESSAALDSQVIYEGFSNFQDFVKTPSQYTNRVIAQNAKRFKEWGITSFEFAPQYVSSQDGTFLDSIIENGYAFEDRYDIAMSKNNKYGSLKDLMDALRALHAEGISAIADWVPDQIYNLPGKEVVTASRTNSYGTPRPNAEIYNSLYAAKTRTFGNDFQGKYGGAFLDELKAKYPAIFERVQISNGRKLTTNEKITQWSAKYFNGSNIQGTGARYVLQDNATNQYFNLKAGQTFLPKQMTEITATGFRRVGDKVQYLSTSGYLAKNTFIQIGANQWYYFDKNGNMVTGEQVIDGKKYFFLDNGLQLRHVLRQGSDGHVYYYDPKGVQAFNGFYDFAGPRQDVRYFDGNGQMYRGLHDMYGTTFYFDEKTGIQAKDKFIRFADGRTRYFIPDTGNLAVNRFAQNPENKAWYYLDSNGYAVTGLQTINGKQYYFDNEGRQVKGHFVTINNQRYFLDGDSGEIARSRFVTENNKWYYVDGNGKLVKGAQVINGNHYYFNNDYSQVKGAWANGRYYDGDSGQAVTNRFVQVGANQWAYLNQNGQKVVGLQHINGKLYYFEGNGVQAKGKLLTYKGKKYYFDANSGEAVTNRFIQISRGVWYYFNASGQAVTGEQVINGQHLYFDASGRQVKGRYVWIKGQRRYYDANTGAWVRNR

SEQ ID NO: 39 - DNA, 3933 bp, Streptococcus gallolyticus ATCC 43143
atgatcgacggcaaatactactatgttcaggcagatggcagcgttaagaagaatttcgcgattacggtcaacggtcagctgctgtactttgatgctgagactggcgctctgacgagcacgagcacttatagctttaccgaaggcctgaccaatctggtggataactttagcaagaacaatcaagcgtatgacagcacggagaaatcctttgagctggttgatggctacctgacggcgaacagctggtatcgtccgactaaagttttggagaatggcgaaacctgggttgacagcaccgaagagagcttccgtccactggtgatggcttggtggcctgacgtcgatacccagattaactacctgaacagcatgagcgaatactttggtttgaataagaagtattctgcatcggatagccaagcatctctgaatgtggcggctgaagcgatccaggtgaaaattgagcaggagattgcgcgtcgtggttcgaccgagtggttgcgtgaggtcattagctcttttgttacgacccaagataagtggaatatgaacagcgaagatcgcgacactgaccacctgcaaggtggcgcactgctgtatgtcaacagcgatctgactgagtgggccaatagcgattaccgcctgctgaaccgcgctccgacctatcaaactggtgaaactaagtaccacaaagccgaccgcacgggtggctacgacttcctgctggcgaatgatgttgacaatagcaatccggttgttcaggccgaacaactgaatcagctgtactacctgatgaactggggtaagattgtgttcggtgacgcagatgcaaacttcgatggcgtccgtgttgacgcggtggacaacgtggatgctgatctgttgcaaatctacacgaatctgtttgaagcggcctacggcgtcgataagaccgaagcacaagcgctggcgcatattagcatcttggaagcgtggagcttcaacgacccggactataatcacgacaccaacggtgcagcactggccatcgacaacggtctgcgtatggccttcctggatgctctgactcgtcctctggactcccgcactaatttggagagcctgattcacaacgatctgggcatgactgaccgtaccgtcgatagcgcgtatggtgatgctatgccgagctatgccttcgtccgtgcccacgactctgaagttcagggcatcattgcatctatcatcgccggtcagatcaatccgaaaacggacggttttacctttaccttggatgagctgcaaaaggcattcgaaatctacaacgccgacatgaactccgtgcacaagaagtatacccatttcaatatcccagcagcatacgctttgctgctgaccaacatggagagcgttccgcgtgtatactatggcgatttgttcaccgataacggtcagtacatggccgttaaaagcccgtactacgaccagatcaccgcgctgctgaagtctcgtatcaagtacgcggcaggcggtcaagccatgaatgtgcaatacccggatggtgcgggtgcgggtatcctgacttctgtgcgcttcggctatggcattatgacggcggatcaaaaagcgaccgacgacagcgttactaccagcggcattgtcaccattgtttccaacaacccgaacctgaaactgaatagcagcgacaaaattgcggtgcaagttggtctggcacacgcaggccaatactaccgtccgctgctgtctccgacggagaatggtctgcaagtgttcctgaatgattccgacaccgacatcaccaagctggtcgatgataacggttacatctatttcacgggtgatgagatcaaaggtttcgagactgtggacatgaatggcttcctgaccgtttgggttccggtgggtgcggcagccgatcaggatattcgcgtcaaggcgagcacggaagcgaagaaggatggtgagctgacctatgaaacctctgcggcgctggattctcaggtcatttttgaaggctttagcaactttcaagactttgttcaggacccaagccagtacaccaataaggtgattgcggagaatgcggatctgttcgcgagctggggcatcacgtctttcgagctggcaccgcagtatgttagcagcacggacggtacgttcctggacagcattattcagaacggttatgcttttacggatcgttatgacttggcgatgtctaagaacaataagtatggtagcgcagaagatttgcgcaatgcgattaaagcgctgcacgcacgcggtattcaagtgattgctgattgggtccctgaccagatttatgcgctgcctggtgaagagattgtgacggcgacccgtgttaatgactacggcgaagaacgtgaaggcgcgcaaatcaagaacaaaccgtatgcggcgaatacgaaaagctccggtgaggattaccaagcccaatacggtggcgagttcttggaatatctgcaagagaattacccggagttgtttgaaaaggtcatgattagcacgggtaagaccattgacccatcgacgaagatcaaggtctggaaagcggagtatttcaacggcacgaatattctgggtaagggtgccgattacgtcctgaacgatgcggccaccggcacctacttcaccgtaacggagaacggcgccttcctgccgaaacaaatgacgagcgataccgcccaaacgggtttctattatgatggcaccggcatgacgtactattctacctcgggttaccaagctaagtctagcttcgtgctgtacaacggcaaccgttactatttcgatgaaaacggtcacatggttacgggtatgcgcgatattgatggtcagacgtactactttctgccgaatggtatcgaactgcgtgacgcgatctatgaggacgcgaacggtaatcagtattactttggcaaatcgggtaaccgctacgcgggtcattactacgcctttgaaaccacgagcaccgttgacggtgtcaccaagaccactactaactggcgctattttgatgaaaacggcgttatggcacgcggcctggtgaaaatcggtaatgattatcaatactacgacgataacggcaatcagatcaagggtcaactggtgacggacaaggacggcaacacccgttactttaaagctgacagcggtgcaatggttacgggtgagtttgcactggtgaatggtggttggtactacttcgatgacaatggtgttgcagtcaaaggtgctcagaccattaacggtcaacagttgtacttcgacgagaatggtgtccaagcaaaaggtgtgttcgtgaccaatgaggatggcacccgtagctattacgacgccaagtccggtgagaagtttgttggcgacttctttacgaccggcgacaaccattggtactatgccgacgagaacggcaatttggcaacgggtagccaggttatccgtggtcagaagttgtattttgcagccgatggtttgcaggcgaaaggtatctttaccaccgacgccgaaggtaaccgccacttctacgacccggactccggcgatctggcggaaaacaagtttatcgcggatggtgacgactggtactattttgacgaaacgggtcatgttgttaccggcgagcaagtgatcaacggccaacagctgtatttcgacgaaaatggcgttcaggcgaagggtgttttcgtgaccgatgataatggtaataagcgttactatgatgcacagacgggtgagatggtggtgaaccagacgctgacggtggatggtgtggaatatacctttggtgcggatggcgtcgcggtggttaatgcacaagatagcgacgaacaaagcgaaagcacggatgaaacgcaagtgaccagcgatgacgcgacggttgcaaagacggaaaccagctctgctgaataa

SEQ ID NO: 40 - protein, 1310 aa, Streptococcus gallolyticus ATCC 43143
MIDGKYYYVQADGSVKKNFAITVNGQLLYFDAETGALTSTSTYSFTEGLTNLVDNFSKNNQAYDSTEKSFELVDGYLTANSWYRPTKVLENGETWVDSTEESFRPLVMAWWPDVDTQINYLNSMSEYFGLNKKYSASDSQASLNVAAEAIQVKIEQEIARRGSTEWLREVISSFVTTQDKWNMNSEDRDTDHLQGGALLYVNSDLTEWANSDYRLLNRAPTYQTGETKYHKADRTGGYDFLLANDVDNSNPVVQAEQLNQLYYLMNWGKIVFGDADANFDGVRVDAVDNVDADLLQIYTNLFEAAYGVDKTEAQALAHISILEAWSFNDPDYNHDTNGAALAIDNGLRMAFLDALTRPLDSRTNLESLIHNDLGMTDRTVDSAYGDAMPSYAFVRAHDSEVQGIIASIIAGQINPKTDGFTFTLDELQKAFEIYNADMNSVHKKYTHFNIPAAYALLLTNMESVPRVYYGDLFTDNGQYMAVKSPYYDQITALLKSRIKYAAGGQAMNVQYPDGAGAGILTSVRFGYGIMTADQKATDDSVTTSGIVTIVSNNPNLKLNSSDKIAVQVGLAHAGQYYRPLLSPTENGLQVFLNDSDTDITKLVDDNGYIYFTGDEIKGFETVDMNGFLTVWVPVGAAADQDIRVKASTEAKKDGELTYETSAALDSQVIFEGFSNFQDFVQDPSQYTNKVIAENADLFASWGITSFELAPQYVSSTDGTFLDSIIQNGYAFTDRYDLAMSKNNKYGSAEDLRNAIKALHARGIQVIADWVPDQIYALPGEEIVTATRVNDYGEEREGAQIKNKPYAANTKSSGEDYQAQYGGEFLEYLQENYPELFEKVMISTGKTIDPSTKIKVWKAEYFNGTNILGKGADYVLNDAATGTYFTVTENGAFLPKQMTSDTAQTGFYYDGTGMTYYSTSGYQAKSSFVLYNGNRYYFDENGHMVTGMRDIDGQTYYFLPNGIELRDAIYEDANGNQYYFGKSGNRYAGHYYAFETTSTVDGVTKTTTNWRYFDENGVMARGLVKIGNDYQYYDDNGNQIKGQLVTDKDGNTRYFKADSGAMVTGEFALVNGGWYYFDDNGVAVKGAQTINGQQLYFDENGVQAKGVFVTNEDGTRSYYDAKSGEKFVGDFFTTGDNHWYYADENGNLATGSQVIRGQKLYFAADGLQAKGIFTTDAEGNRHFYDPDSGDLAENKFIADGDDWYYFDETGHVVTGEQVINGQQLYFDENGVQAKGVFVTDDNGNKRYYDAQTGEMVVNQTLTVDGVEYTFGADGVAVVNAQDSDEQSESTDETQVTSDDATVAKTETSSAE

SEQ ID NO: 41 - DNA, 3804 bp, Streptococcus mutans
atggtcaatggcaaatactactactacaaagaggacggtacgttgcagaagaactacgcactgaacattaacggcaagacctttttctttgacgagactggcgccctgagcaataacaccctgccgagcaagaaaggtaacatcaccaataacgacaataccaatagcttcgcgcaatacaatcaggtgtattcgacggatgcagcgaacttcgaacatgtcgatcactacctgacggcggagtcctggtatcgcccgaagtatattctgaaagatggcaagacgtggactcagtccacggagaaagattttcgcccgttgttgatgacctggtggccggatcaggaaacccagcgtcagtatgtaaactatatgaatgcccagctgggtattcaccagacctacaacacggcgaccagcccgttgcaactgaatctggcggcacagacgatccagaccaagattgaagagaagatcacggcggagaagaacactaattggctgcgtcaaacgatttcggcctttgtcaaaacccagagcgcgtggaactcggacagcgaaaaaccgtttgacgatcatctgcaaaagggtgcactgctgtactctaacaatagcaagttgacctctcaagctaatagcaactaccgtattctgaaccgtaccccaaccaaccaaaccggcaagaaagatccgcgttataccgctgaccgtaccatcggtggttatgagttcttgctggcgaacgatgtggataatagcaatcctgttgttcaagcggaacagctgaactggctgcacttcctgatgaactttggcaatatctatgcaaacgaccctgacgccaactttgacagcatccgtgtagacgccgtggacaacgtggatgcagatttgttgcaaatcgctggtgactatctgaaggctgcaaagggcatccataagaacgacaaagcagcgaacgaccacctgtcgatcctggaagcatggagctataatgacaccccgtatctgcacgacgacggtgacaacatgatcaatatggacaaccgtctgcgtctgagcctgctgtatagcctggcgaagccgttgaaccagcgttcgggcatgaacccgctgatcacgaacagcctggttaaccgtaccgatgacaacgcagaaaccgcagcggtcccgagctacagctttatccgtgcacacgatagcgaggttcaagacctgattcgtaacattattcgtgctgagattaatccgaacgtcgtcggttatagcttcacgatggaagagatcaagaaggcctttgagatttacaacaaggatctgctggcgacggaaaagaaatacacccactataacaccgcgctgagctacgcgctgctgctgaccaataagagcagcgttccgcgtgtgtattacggtgatatgtttactgacgacggtcagtacatggcacataaaacgatcaactacgaggctatcgaaacgctgttgaaggcgcgcattaagtacgtgtctggtggccaagcgatgcgtaatcaacaggtgggtaatagcgaaatcattacgagcgtccgctatggcaagggcgcactgaaagcgacggataccggcgatcgtaccacgcgcaccagcggcgttgcggttattgaaggcaataacccgagcctgcgcttgaaggcgagcgaccgcgtcgttgttaacatgggtgcagcacacaagaaccaggcatatcgtccgctgttgctgaccactgataatggcatcaaagcgtatcacagcgatcaggaagctgcgggcctggtgcgctataccaatgatcgtggtgaattgatcttcacggcagctgacattaaaggttatgcaaatccgcaagtcagcggttatctgggcgtctgggtgccggtcggcgcagcggctgatcaagacgtgcgtgtggccgcgagcaccgcgccatcgaccgacggtaaaagcgtgcaccagaatgcggcgctggacagccgtgtcatgtttgagggttttagcaactttcaagcctttgcaacgaagaaagaagagtacaccaacgtcgtcatcgcgaagaacgtcgataagttcgcggaatggggcgttaccgatttcgaaatggcaccgcagtatgtgtctagcaccgatggctcgtttctggattccgtgatccaaaatggttatgcatttaccgaccgctatgacctgggcattagcaagccgaataagtatggtacggcggatgatctggttaaagcgatcaaggcgctgcattctaaaggtattaaggttatggccgactgggttccagatcagatgtatgctttcccggaaaaagaagtggtgacggccacccgcgtggacaaatatggtacgccggtcgcgggcagccagatcaaaaacactctgtatgtcgtggatggcaaaagctccggtaaagatcagcaagcgaaatatggcggtgccttcctggaagagttgcaggcgaaatacccggaactgttcgcgcgtaagcagatcagcactggtgttccgatggacccgagcgtgaagattaaacaatggtccgcgaaatactttaacggcacgaacatcctgggtcgtggtgccggctacgtgctgaaagaccaggcaacgaatacgtactttagcttggtgtccgacaatacgtttctgccgaagtctctggtcaacccgaaccacggtacgagcagctctgtgaccggcctggtgttcgatggtaagggctacgtgtactactctaccagcggttaccaggccaagaatacgttcatcagcctgggtaacaactggtattacttcgacaataacggttacatggtcacgggtgcgcagagcatcaacggtgccaactactattttctgagcaacggcattcagctgcgtaatgcgatttacgacaatggcaataaggttctgagctactacggtaatgacggtcgtcgttatgagaatggctattacctgtttggccaacagtggcgctactttcaaaatggtattatggccgtcggtctgacccgtgtccacggtgcggtgcagtattttgacgccagcggcttccaagccaagggccagttcatcaccactgcggacggtaaactgcgttactttgaccgtgacagcggcaaccaaatcagcaatcgttttgttcgtaacagcaagggtgaatggtttttgttcgatcataacggcgtggcggttaccggcaccgttactttcaatggtcaacgtctgtactttaagccgaacggtgttcaggcaaagggtgagttcattcgcgacgcggatggtcacttgcgttactacgaccctaattccggtaatgaggttcgtaaccgtttcgtccgcaactctaagggcgaatggttcctgtttgaccacaatggcatcgcagtcaccggcgctcgtgtggtcaacggccaacgcttgtacttcaaaagcaatggcgtccaagctaagggtgagctgattaccgaacgtaagggccgtattaagtattatgatcctaacagcggtaacgaagtgcgtaaccgctacgtccgcaccagcagcggtaattggtactattttggtaacgatggttacgcgctgatcggctggcatgttgttgagggtcgtcgtgtgtactttgatgagaacggtgtctatcgttacgcgagccacgaccagcgtaatcattggaactacgactatcgtcgcgatttcggtcgtggtagcagctccgctatccgttttcgccatagccgtaacggctttttcgacaacttcttccgcttctaa

SEQ ID NO: 42 - protein, 1267 aa, Streptococcus mutans
MVNGKYYYYKEDGTLQKNYALNINGKTFFFDETGALSNNTLPSKKGNITNNDNTNSFAQYNQVYSTDAANFEHVDHYLTAESWYRPKYILKDGKTWTQSTEKDFRPLLMTWWPDQETQRQYVNYMNAQLGIHQTYNTATSPLQLNLAAQTIQTKIEEKITAEKNTNWLRQTISAFVKTQSAWNSDSEKPFDDHLQKGALLYSNNSKLTSQANSNYRILNRTPTNQTGKKDPRYTADRTIGGYEFLLANDVDNSNPVVQAEQLNWLHFLMNFGNIYANDPDANFDSIRVDAVDNVDADLLQIAGDYLKAAKGIHKNDKAANDHLSILEAWSYNDTPYLHDDGDNMINMDNRLRLSLLYSLAKPLNQRSGMNPLITNSLVNRTDDNAETAAVPSYSFIRAHDSEVQDLIRNIIRAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKATDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYAFPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFSLVSDNTFLPKSLVNPNHGTSSSVTGLVFDGKGYVYYSTSGYQAKNTFISLGNNWYYFDNNGYMVTGAQSINGANYYFLSNGIQLRNAIYDNGNKVLSYYGNDGRRYENGYYLFGQQWRYFQNGIMAVGLTRVHGAVQYFDASGFQAKGQFITTADGKLRYFDRDSGNQISNRFVRNSKGEWFLFDHNGVAVTGTVTFNGQRLYFKPNGVQAKGEFIRDADGHLRYYDPNSGNEVRNRFVRNSKGEWFLFDHNGIAVTGARVVNGQRLYFKSNGVQAKGELITERKGRIKYYDPNSGNEVRNRYVRTSSGNWYYFGNDGYALIGWHVVEGRRVYFDENGVYRYASHDQRNHWNYDYRRDFGRGSSSAIRFRHSRNGFFDNFFRF

SEQ ID NO: 43 - DNA, 3864 bp, Streptococcus mutans UA159
atgattgacggcaaatactactacatcggcagcgacggtcagccaaagaagaattttgcgttgacggttaacaataaagtcctgtattttgacaagaacacgggtgcgctgaccgacaccagccaatatcagttcaaacaaggtctgacgaagctgaacaacgactacacccctcacaatcagattgtcaactttgaaaatactagcctggaaactattgataactatgttactgccgactcttggtatcgtccgaaagacattctgaagaacggtaagacgtggaccgcgtcctctgagagcgatctgcgtccgctgctgatgtcctggtggcctgataagcagacccagatcgcatacctgaactacatgaaccaacaaggcttgggcactggcgagaactataccgctgatagctctcaagagagcctgaacctggcggcacaaaccgttcaagtcaaaatcgaaaccaagatcagccaaacgcaacagactcagtggctgcgtgacatcattaactctttcgttaagacgcaaccgaactggaatagccaaaccgagtctgacacgagcgctggtgaaaaagatcatttgcagggcggtgccctgctgtatagcaattcggacaaaaccgcatacgcaaatagcgactatcgtctgctgaaccgtaccccgaccagccagactggtaagccgaaatacttcgaggacaatagcagcggtggttacgacttcctgttggcaaacgatattgataattccaatccggtggtgcaggctgagcagctgaattggctgcattacctgatgaattacggtagcattgtcgcaaatgacccggaagcgaatttcgatggtgtccgtgttgacgcggtggataacgtgaacgcagacctgttgcagatcgcaagcgattatctgaaagcccattatggtgttgataagagcgagaagaatgcgatcaaccacctgagcatcctggaagcgtggtctgacaacgacccacagtataacaaagacaccaaaggtgcccagctgccgatcgacaacaaactgcgtctgtcgttgctgtacgcactgacccgtccgctggagaaggatgcaagcaacaaaaatgagattcgtagcggtctggagccggttattaccaattccctgaataatcgttccgctgagggcaagaactctgaacgcatggcgaattacatcttcatccgtgctcacgattctgaagttcaaacggtgatcgcaaagatcatcaaagcgcagattaacccgaaaacggatggcctgaccttcaccctggatgagctgaaacaggcgttcaaaatctataacgaggatatgcgccaggcgaagaagaagtatacccagagcaatatcccgacggcatacgccctgatgctgagcaataaggactccatcacgcgcctgtattacggtgatatgtacagcgatgatggccaatacatggcgaccaaatccccgtactacgatgcgattgacaccctgctgaaggcgcgcattaagtatgccgctggcggtcaggatatgaagatcacctacgttgagggtgacaaaagccacatggactgggactatacgggtgtcctgacgagcgttcgctacggcacgggcgcaaacgaagcgaccgaccagggcagcgaagctaccaagacgcaaggtatggccgtcatcacttctaacaacccgtccctgaagctgaatcagaacgacaaggtcattgtcaatatgggcaccgctcacaaaaatcaggaataccgtccgttgctgctgaccaccaaagacggtctgaccagctacaccagcgacgccgctgccaagagcctgtaccgtaaaacgaacgataagggcgagttggtgttcgatgcaagcgacattcagggctatctgaatccgcaagtgagcggttacctggctgtttgggtgcctgtgggtgcgagcgacaaccaggatgtgcgtgtcgcggccagcaataaagccaatgcgaccggccaagtctatgaaagcagcagcgcactggatagccaactgatttatgagggtttttccaactttcaggacttcgtcaccaaggattctgattacaccaataaaaagatcgcgcaaaatgtccagctgtttaagagctggggcgtcaccagctttgagatggctccgcaatacgtcagcagcgaggacggcagctttttggacagcattatccagaacggctatgcgttcgaggatcgttacgacctggcgatgagcaaaaacaacaaatacggctcccagcaggacatgatcaacgcggttaaggcgctgcataagagcggtatccaagtgatcgcggactgggtcccggatcaaatctacaatttgccgggtaaagaggtcgtcaccgcgacccgtgtgaacgactacggcgagtatcgcaaggactccgaaatcaaaaacaccctgtacgccgccaacaccaaaagcaacggtaaagattatcaagcaaagtacggtggcgcctttttgagcgagctggccgccaaatatccgagcatctttaaccgcactcagattagcaatggcaagaagatcgacccgtctgaaaagatcaccgcctggaaggccaaatacttcaatggtacgaacattttgggtcgcggcgttggttacgtcttgaaagacaatgccagcgacaagtattttgagctgaagggcaatcagacttatctgccgaagcaaatgacgaataaagaagcctcgactggtttcgttaatgacggcaatggtatgaccttttacagcacgagcggttatcaagcgaagaacagcttcgttcaggacgcaaaaggcaactggtactactttgacaacaatggccacatggtttacggtctgcaacatctgaacggcgaggtgcaatacttcctgagcaatggcgtgcaactgcgtgaatccttcttggaaaatgccgacggcagcaaaaactatttcggtcacctgggcaaccgttatagcaatggttactacagcttcgataatgatagcaaatggcgctatttcgatgcgagcggtgttatggcagtgggtctgaaaactattaacggtaacacccagtatttcgatcaagacggctaccaagtgaagggtgcatggattaccggcagcgatggtaagaagcgttacttcgacgacggtagcggcaatatggcagttaatcgctttgctaacgacaagaatggcgattggtattacctgaatagcgacggtattgcactggtgggtgttcagaccatcaacggcaaaacgtattactttggccaagatggtaaacaaatcaaaggcaaaatcattaccgataatggtaaactgaaatactttctggcgaacagcggtgagctggcgcgtaacatttttgcgaccgacagccagaacaactggtattacttcggctcggatggtgttgcggttacgggttcgcagacgattgcgggtaaaaagttgtactttgcgtccgacggtaaacaggtgaagggtagctttgttacttacaatggtaaagtgcactattaccatgcggacagcggcgaactgcaagtcaaccgtttcgaggcggataaagacggtaattggtactatctggacagcaacggtgaggcactgacgggtagccagcgtatcaatggtcaacgtgtgtttttcacccgcgagggcaaacaggttaagggtgatgtcgcgtatgatgaacgcggcttgctgcgctattacgacaaaaacagcggtaatatggtgtacaacaaggtggtcacgctggcgaacggtcgtcgtattggtattgaccgctggggtattgctcgctattactaa

SEQ ID NO: 44 - protein, 1287 aa, Streptococcus mutans UA159
MIDGKYYYIGSDGQPKKNFALTVNNKVLYFDKNTGALTDTSQYQFKQGLTKLNNDYTPHNQIVNFENTSLETIDNYVTADSWYRPKDILKNGKTWTASSESDLRPLLMSWWPDKQTQIAYLNYMNQQGLGTGENYTADSSQESLNLAAQTVQVKIETKISQTQQTQWLRDIINSFVKTQPNWNSQTESDTSAGEKDHLQGGALLYSNSDKTAYANSDYRLLNRTPTSQTGKPKYFEDNSSGGYDFLLANDIDNSNPVVQAEQLNWLHYLMNYGSIVANDPEANFDGVRVDAVDNVNADLLQIASDYLKAHYGVDKSEKNAINHLSILEAWSDNDPQYNKDTKGAQLPIDNKLRLSLLYALTRPLEKDASNKNEIRSGLEPVITNSLNNRSAEGKNSERMANYIFIRAHDSEVQTVIAKIIKAQINPKTDGLTFTLDELKQAFKIYNEDMRQAKKKYTQSNIPTAYALMLSNKDSITRLYYGDMYSDDGQYMATKSPYYDAIDTLLKARIKYAAGGQDMKITYVEGDKSHMDWDYTGVLTSVRYGTGANEATDQGSEATKTQGMAVITSNNPSLKLNQNDKVIVNMGTAHKNQEYRPLLLTTKDGLTSYTSDAAAKSLYRKTNDKGELVFDASDIQGYLNPQVSGYLAVWVPVGASDNQDVRVAASNKANATGQVYESSSALDSQLIYEGFSNFQDFVTKDSDYTNKKIAQNVQLFKSWGVTSFEMAPQYVSSEDGSFLDSIIQNGYAFEDRYDLAMSKNNKYGSQQDMINAVKALHKSGIQVIADWVPDQIYNLPGKEVVTATRVNDYGEYRKDSEIKNTLYAANTKSNGKDYQAKYGGAFLSELAAKYPSIFNRTQISNGKKIDPSEKITAWKAKYFNGTNILGRGVGYVLKDNASDKYFELKGNQTYLPKQMTNKEASTGFVNDGNGMTFYSTSGYQAKNSFVQDAKGNWYYFDNNGHMVYGLQHLNGEVQYFLSNGVQLRESFLENADGSKNYFGHLGNRYSNGYYSFDNDSKWRYFDASGVMAVGLKTINGNTQYFDQDGYQVKGAWITGSDGKKRYFDDGSGNMAVNRFANDKNGDWYYLNSDGIALVGVQTINGKTYYFGQDGKQIKGKIITDNGKLKYFLANSGELARNIFATDSQNNWYYFGSDGVAVTGSQTIAGKKLYFASDGKQVKGSFVTYNGKVHYYHADSGELQVNRFEADKDGNWYYLDSNGEALTGSQRINGQRVFFTREGKQVKGDVAYDERGLLRYYDKNSGNMVYNKVVTLANGRRIGIDRWGIARYY

SEQ ID NO: 45 - DNA, 4068 bp, Streptococcus gallolyticus ATCC BAA-2069
atgatcgacggcaaatactactatattgacgaggacggtaacgtaaagaagaatttcgcgattacggtggatggtcagttgctgtacttcgacgctgaaacgggtgctctgaccagcacgtccacctatagcttctccgagggcctgactaatctggtcgataacttcagcattaacaaccagtcctacgacagcaccgaagagtcgtttgagctgatcgacggttacctgaccgtcaatacttggtaccgtccgaccaaaattctggaaaacggtgaaacctgggtcgatagcaccgaaacggatttccgtccgctgctgatggcctggtggccggatgttgacacccaaattgactacttgaactacatgagcgattacttcgatctgggtacgacctatagcgctgacgattcccaagcgagcctgaatctggcagctgaggcggttcaggtgaaaattgaacaagaaattacccgtcaagagaacaccgcctggctgcgcgagatcatctctagctttgttaccacccaggataaatggaatatcaataccgagaatgagggcaccgaccatctgcaaggtggtgccctgctgtacgttaacagcgacttgactccgtgggcaaacagcgattatcgcctgctgaaccgcaccccgacgtaccagacgggtgagactaattactttaaagcagatcgtactggtggctacgaatttctgctggcaaatgacgtggataattctaacccggtcgttcaagccgaacagttgaaccagctgtactacttgatgaattggggctctattgtattcggtgatgacgacgccaattttgatggcgtgcgtgttgacgcggtggacaatgtgaacgctgacctgttgcagatttacacgaacctgttcgaagcggcgtatggtgttaacgagtctgaggcgcaggccctggctcacattagcatcctggaagcgtggtcttataacgacccggactacaaccacgacacgaatggcgctgccctggcaatcgacaatggtctgcgtctgagctttctgtactctttgacgcgccctacggacgagcgcagcggtttggagccactgatcacctctgagattggcctgaccgatcgttccgaggactctgcatacggtgacaccatgccgagctatgttttcgtccgtgcacatgacagcgaggttcagaccattattgcgagcattatcgcagaacagatcaacccggaaaccgatggctataccttcaccctggacgagctgaaccaggcgtttgagatttacaacgcggatatgaacagcgtggataaagagtatacgcattacaatatcccggctgcgtatagcctgctgctgaccaacatggaaagcgtcccgcgtgtttactacggtgacctgtatacggataacggtcagtacatggcgactaagagcccgtattatgaccagatcaccaccctgctgcaagcgcgcattcgttacgcggcgggtggccaatctatggctgttacgtactacacccctgcgtcgagcatgtctaccgacaatgcggatagcgtcctgaatgagactggtgtgctgacttctgtgcgttacggctatggcatcatgaccgccgaccaagaggccacggacgactccgttctgacctctggtattgttactattatcagcaacaaccctaatttgcagctggatgattccgaagtgattgcagtccaggttggtgtggcgcacgctggtcagtattatcgtccgctgttgtacccgacggcggatggtctgcaaagctacctgaacgatagcgataccgacattactaagctggtcgatgataatggttatatctactttacggcagatgagattaaaggctacgaaacggttgacatgaatggctacctgagcgtttgggtcccggttggtgcagacgagaatcaggacatccgtgtcagcgcagacaccagcgcgtacaccgagggtgaattgatctatcaagcaaccgcagcgctggatagccaagtgatctacgagggtttcagcaacttccaagatttcgttacctctaacagcgagtacactaacaagctgatcgcggagaacgtcgatctgtttaccagctggggcattacgagctttgagatggcgccacagtatgtgagcaccgatgacggtacttttctggatagcatcattcaaaacggttatgcatttgacgatcgctacgacctggcaatgagccagaataacaagtatggtagcgctgaagatttgcgtaatgccatcaaggccctgcacgctgctggcattcaggtcattgctgactgggtgccggatcaaatctattcgctgccaggcgaagaagtcgttacggcgactcgcgtgaatgactatggcgaagaaaccgaaggcgcgtacattaacaatacgttgtatgtggcgaacagcaaaagcagcggcgaggactaccaggcacagtatggtggtgagttcctggattacttgcaagaaacctacccggaaatgttcgaagttgcgatgattagcacgggtgagccgattgatccgagcaccaagatcaagatttggaaagcagaatactttaatggtacgaacattctgggtaagggcgctggttacgtgctgagcgatgccgcgactggcacgtactttaccgtgactgagaatggcacgtttctgccgaagcagctgaccaccgactccgccattacgggtttctattacgacggtacgggtatgtcttactttagcacctcgggttatcgcgctaaagcgagcttcattgtttacaacggctactactactattttgatgataacggctacatggtcactggcacggtggaaatcaacggtaagacctactatttcctgccgaatggtattcagctgcgtgatgcgatttacgaagacgagaacggtaatcagtactatttcggtccgttgggcaaccagtatttcaacaactattacagctttgacgttgaagaggtggtggacggtgtaacgactacggtaacgaagtggcgtcattttgacgagaacggcgtgatggcgcgtggtttggtcgagattgatggtgtctaccagtattacgatgaaaacggctaccaggtcaaaggtgagctgatcaccgatgctgatggtaatttgcgttatttcaaagaagatagcggtgaaatggttgttagcgattttgtgaagatcggcgataacaactggtactactttgacgaaaacggtattgcagtcacgggtgcccaaaccattgccggccagaacttgtatttcgatgacaacggtgtgcaggcgaaaggtgcctttgtcacgaacgccgatggcacgcgcagctattatgacgcggacagcggtgagaagatcgtggcagatttcttcactacgggcgataatgactggtattatgcagatgaaaatggcaatctggtgactggtagccaaactatcaatggtcaaaacctgtactttgctgaggacggtttgcaggccaagggtgtgtttgttaccgatacggctggtaacattcactattatgatgcgaactctggcgagttggcggttaataccttcgttggtgatggcgacgactggtattactttgatgagaatggcatcgcagttaccggcgcacaagtcattaacggtcaacacctgtatttcgcagacaacggcatccaagtgaaaggtgaaatcgtcaccgacgcaaacggcaaccgctattactacgatgcagattccggcgaaatggcagttaacacctttgtggagattgacggtgtttggtactattttggtgccgatggtatcgcggtgacgggtgcacaagtaattgatggtcagaatttgtactttaacgcagacggtagccaagtcaagggtgacgttgtccgtatcaacggtttgcgttactactacgacgctaatagcggcgaacaggtgcgcaatcagtgggtcacgctgccggatggtactgttgttttctttaatgcgcgtggctatacttggggctaa

SEQ ID NO: 46 - protein, 1355 aa, Streptococcus gallolyticus ATCC BAA-2069
MIDGKYYYIDEDGNVKKNFAITVDGQLLYFDAETGALTSTSTYSFSEGLTNLVDNFSINNQSYDSTEESFELIDGYLTVNTWYRPTKILENGETWVDSTETDFRPLLMAWWPDVDTQIDYLNYMSDYFDLGTTYSADDSQASLNLAAEAVQVKIEQEITRQENTAWLREIISSFVTTQDKWNINTENEGTDHLQGGALLYVNSDLTPWANSDYRLLNRTPTYQTGETNYFKADRTGGYEFLLANDVDNSNPVVQAEQLNQLYYLMNWGSIVFGDDDANFDGVRVDAVDNVNADLLQIYTNLFEAAYGVNESEAQALAHISILEAWSYNDPDYNHDTNGAALAIDNGLRLSFLYSLTRPTDERSGLEPLITSEIGLTDRSEDSAYGDTMPSYVFVRAHDSEVQTIIASIIAEQINPETDGYTFTLDELNQAFEIYNADMNSVDKEYTHYNIPAAYSLLLTNMESVPRVYYGDLYTDNGQYMATKSPYYDQITTLLQARIRYAAGGQSMAVTYYTPASSMSTDNADSVLNETGVLTSVRYGYGIMTADQEATDDSVLTSGIVTIISNNPNLQLDDSEVIAVQVGVAHAGQYYRPLLYPTADGLQSYLNDSDTDITKLVDDNGYIYFTADEIKGYETVDMNGYLSVWVPVGADENQDIRVSADTSAYTEGELIYQATAALDSQVIYEGFSNFQDFVTSNSEYTNKLIAENVDLFTSWGITSFEMAPQYVSTDDGTFLDSIIQNGYAFDDRYDLAMSQNNKYGSAEDLRNAIKALHAAGIQVIADWVPDQIYSLPGEEVVTATRVNDYGEETEGAYINNTLYVANSKSSGEDYQAQYGGEFLDYLQETYPEMFEVAMISTGEPIDPSTKIKIWKAEYFNGTNILGKGAGYVLSDAATGTYFTVTENGTFLPKQLTTDSAITGFYYDGTGMSYFSTSGYRAKASFIVYNGYYYYFDDNGYMVTGTVEINGKTYYFLPNGIQLRDAIYEDENGNQYYFGPLGNQYFNNYYSFDVEEVVDGVTTTVTKWRHFDENGVMARGLVEIDGVYQYYDENGYQVKGELITDADGNLRYFKEDSGEMVVSDFVKIGDNNWYYFDENGIAVTGAQTIAGQNLYFDDNGVQAKGAFVTNADGTRSYYDADSGEKIVADFFTTGDNDWYYADENGNLVTGSQTINGQNLYFAEDGLQAKGVFVTDTAGNIHYYDANSGELAVNTFVGDGDDWYYFDENGIAVTGAQVINGQHLYFADNGIQVKGEIVTDANGNRYYYDADSGEMAVNTFVEIDGVWYYFGADGIAVTGAQVIDGQNLYFNADGSQVKGDVVRINGLRYYYDANSGEQVRNQWVTLPDGTVVFFNARGYTWG

SEQ ID NO: 47 - DNA, 4047 bp, Streptococcus sanguinis SK405
atgatcgatggcaagaaatactatgttcaggacgacggtacggtaaagaagaatttcgcggttgaactgaacggcaaggtcctgtatttcgatgcagaaaccggtgccctggtcgacagcgcggagtaccagtttcaacagggtacgagctccctgaataacgagttcagccgcatgaatgcgttccatggcacgacggagaaagatattgaaaccgtcgatggctatctgaccgcagatacgtggtaccgcccgaaggccatcctgaaagatggcaaaacctggactcagagcaccgaaaccgatctgcgtccgctgctgatggcatggtggccggacaaacaaacgcaggtaagctacttgaactatatgaaccagcagggtctgggtgcgggtgcgtttgagaacaaagttgagcaggcaatcttgacgggcgcaagccagcaggtgcagcgcaagatcgaagaacgtattggcaaagacggcgataccaaatggctgcgtaccctgatgggtgcatttgtgaaaacccagccgaattggaatatcaagacggagagcgaaaccacgggtactaataaggatcatctgcaaggtggtgcgctgctgtacaccaactctgaaaagacgagccacgcgaacagcaaataccgtattctgaatcgtaccccgaccaatcagaccggtacgccgaagtatttcatcgacaaatcgaatggtggttacgagttcttgctggcaaatgattttgataatagcaacccagcagtccaagcggaacagctgaattggctgcactttatgatgaatttcggcagcattgttgcaaatgacccgaccgcaaacttcgatggcgtgcgtgtggatgcggtggacaatgttaatgccgatttgctgcaaattgccagcgactatttcaaatctcgttacaaagtgggcgagagcgaagaacaagcgattaaacatctgagcatcctggaagcctggagcgacaacgatccggactataacaaagacaccaaaggcgcccaactgccgatcgacaataagctgcgtctgagcctgttgtacagctttatgcgtaagctgagcattcgcagcggtgtcgaaccgacgattaccaacagcctgaacgaccgttctgcggagaagaagaacggtgagcgcatggcaaactatatctttgttcgtgcgcatgattccgaagtgcagacggtcattgccgacattattcgcgagaatatcaatccgaacacggatggtctgacctttaccatggacgagctgaaacaggcgttcaagatctacaatgaagatatgcgcaaggcggataagaagtatacccaattcaatattccgaccgctcacgcgttgatgttgagcaacaaggattccattacgcgtgtgtactacggtgacctgtatacggatgatggtcagtatatggaaaagaaaagcccttattacgacgcgatcgacgcgctgctgcgcgcacgcattaagtacgttgcgggtggccaggacatgaaagttacctacatgggtgtgccgcgtgaaaccgacaaatggagctacaacggcatcctgaccagcgtccgctacggcaccggcgcaaatgaggctacggacgagggtactgccgagactcgcacccagggtatggccgtcatcgcaagcaacaatccgaatttgaaactgaacgagtgggataagttgcaggtcaacatgggtgcggcacacaagaaccaatactatcgtccggtgctgctgaccaccaaggacggtattagccgttacctgaccgacgaagaagttccgcaaagcctgtggaagaaaaccgatgcaaacggcatcttgacgttcgacatgaacgatatcgcaggttacagcaatgtccaagtatctggctacttggctgtgtgggtgccggttggtgccaaagcggatcaagacgcgcgtgttactgcgtcgaagaagaaaaacgccagcggtcaggtgtatgagtccagcgctgcactggacagccaactgatttatgaaggcttctctaacttccaagacttcgcgacccgcgacgatcaatacaccaacaaagttattgccaaaaatgttaatctgtttaaagagtggggtgtgaccagctttgagctgccacctcagtatgtttccagccaggatggcacgtttttggatagcatcatccagaatggctacgcatttgaagatcgttatgacatggcgatgagcaaaaacaataagtacggtagcctggacgacctgctgaacgcgctgcgtgccttgcacagcgtcaacatccaagcgatcgcggactgggtcccggatcagatttacaacctgccgggcaaagaagtggttacggctacgcgtgtcaacaattatggtacctatcgtgagggtgcggaaatcaaagaaaatctgtacgtggcaaacacgaaaaccaacggcaccgactatcaaggcaaatacggtggtgcgttcctggacgaactgaaagcgaaatatcctgagatcttcgaacgtgttcaaatttccaatggtcaaaagatgaccaccgatgagaagattacgaaatggagcgcgaaacacttcaatggtaccaacattctgggccgtggtgcatactacgtgctgaaagattgggccagcaatgagtatctgaacaataagaatggtgagatggtgttgccgaagcaactggttaacaaaaacgcgtacaccggctttgttaaggacaccaccggttttaagtactatagcacctcgggctatcaagcgcgtaatagcttcatccaagatgagaacggtaattggtactactttgacaaacgtggttacctggcgactggtgcacacgaaatcgacggcaagcaggtctatttcctgaaaaacggcattcaactgcgcgactctctgcgtgaggacgagaacggcaatcagtactattacgacaagaccggtgcgcaggtgctgaaccgctactacaccaccgacggccagaactggcgttacttcgacgccaaaggtgttatggcgcgtggcctggttaccatgggtggtaaccaacaattcttcgaccagaacggttatcaggtgaaaggcaagatcgcgcgtgccaaggatggtaaactgcgctacttcgacaaagacagcggtaacgcagcggcgaatcgctttgcacagggcgataatccgagcgattggtattactttggtgccgatggcgtcgctgttaccggtttgcaaaaactgggtcaacaaactctgtactttgatcaagaaggtaaacaagtgaagggcaagattgtcacgctggctgataagtccatccgttacttcgatgcgaacagcggcgagatggctgtcggtaagtttgctgagggtagcaagaacgaatggtactatttcgatcagacgggcaaagcggttacgggtctgcaaaagattggccagcagaccctgtattttgaccaagatggtaagcaggtaaagggtaaagtggtaaccctggcagataagtcgattcgctactttgatgcaaactccggcgaaatggcggtgggtaagttcgccgagggtgctaagaatgagtggtactactttgaccaggcgggcaaggcggtgaccggcttgcagaaaattggtcagcaaacgctgtattttgatcaggacggcaaacaagtcaaaggccaactggtgacgctggcggacaagagcattcgttatttcgacgcaaacagcggtgagatggcctctaacaagttcgttgagggtgccaaaaacgaatggtactatttcgaccaagccggtaaagcagtgaccggtctgcaacaaatcggtcagcagaccttgtacttcgaccaaaacggtaaacaggtcaaaggtaaaatcgtgtatgttaacggtgccaatcgttactttgacgccaattcgggtgaaatggcgcgcaataagtggatccaactggaagatggtagctggatgtacttcgatcgtaacggtcgtggtcgtcgtttcggctggaattaa

SEQ ID NO: 48 - protein, 1348 aa, Streptococcus sanguinis SK405
MIDGKKYYVQDDGTVKKNFAVELNGKVLYFDAETGALVDSAEYQFQQGTSSLNNEFSRMNAFHGTTEKDIETVDGYLTADTWYRPKAILKDGKTWTQSTETDLRPLLMAWWPDKQTQVSYLNYMNQQGLGAGAFENKVEQAILTGASQQVQRKIEERIGKDGDTKWLRTLMGAFVKTQPNWNIKTESETTGTNKDHLQGGALLYTNSEKTSHANSKYRILNRTPTNQTGTPKYFIDKSNGGYEFLLANDFDNSNPAVQAEQLNWLHFMMNFGSIVANDPTANFDGVRVDAVDNVNADLLQIASDYFKSRYKVGESEEQAIKHLSILEAWSDNDPDYNKDTKGAQLPIDNKLRLSLLYSFMRKLSIRSGVEPTITNSLNDRSAEKKNGERMANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYYDAIDALLRARIKYVAGGQDMKVTYMGVPRETDKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKADQDARVTASKKKNASGQVYESSAALDSQLIYEGFSNFQDFATRDDQYTNKVIAKNVNLFKEWGVTSFELPPQYVSSQDGTFLDSIIQNGYAFEDRYDMAMSKNNKYGSLDDLLNALRALHSVNIQAIADWVPDQIYNLPGKEVVTATRVNNYGTYREGAEIKENLYVANTKTNGTDYQGKYGGAFLDELKAKYPEIFERVQISNGQKMTTDEKITKWSAKHFNGTNILGRGAYYVLKDWASNEYLNNKNGEMVLPKQLVNKNAYTGFVKDTTGFKYYSTSGYQARNSFIQDENGNWYYFDKRGYLATGAHEIDGKQVYFLKNGIQLRDSLREDENGNQYYYDKTGAQVLNRYYTTDGQNWRYFDAKGVMARGLVTMGGNQQFFDQNGYQVKGKIARAKDGKLRYFDKDSGNAAANRFAQGDNPSDWYYFGADGVAVTGLQKLGQQTLYFDQEGKQVKGKIVTLADKSIRYFDANSGEMAVGKFAEGSKNEWYYFDQTGKAVTGLQKIGQQTLYFDQDGKQVKGKVVTLADKSIRYFDANSGEMAVGKFAEGAKNEWYYFDQAGKAVTGLQKIGQQTLYFDQDGKQVKGQLVTLADKSIRYFDANSGEMASNKFVEGAKNEWYYFDQAGKAVTGLQQIGQQTLYFDQNGKQVKGKIVYVNGANRYFDANSGEMARNKWIQLEDGSWMYFDRNGRGRRFGWN

SEQ ID NO: 49 - DNA, 4284 bp, Streptococcus salivarius
atgaaggatggcaaatactactacttgttggaagatggctcgcacaaaaagaatttcgcaatcaccgtcaatggtcaagtgctgtattttgacgagaacggtgcgctgagcagcaccagcacgtacagcttcacgcaggaaaccaccaatctggttacggactttacgaagaataatgcggcgtatgactccacgaaagcgtctttcgaattggtggacggctatctgaccgcagacagctggtatcgcccgaaagagattctggaagccggcaccacctggaaggcgagcaccgaaaaggacttccgtccgctgctgatgtcctggtggccggataaggacacgcaagttgcttatctgaattacatgacgaaagcactgtcgaacggcgaagaaaccaaggatgtctttacgatcgaaaacagccaagcgagcctgaatgcggcagcgcaaatcctgcaacgtaagattgaggtcaagattgcggccaacaagagcaccgactggctgcgccaaagcatcgaggcgtttgtcaaagaccaagataagtggaatatcaatagcgaaagccctggcaaagagcatttccagaagggtgcgctgctgtttgttaatagcgacagcaccaagtgggcgaactccgattatcgtaaactgaatcagaccgcgacgtcttacatcaagaatcataagatcgtgaacggtagcgatggtggttacgagttcttgctgagcaacgacatcgacaacagcaacccggtggtccaggcagagatgctgaatcaactgtactactttatgaactggggtcagattgtgttcggcgataaagataaagacgcacatttcgatggcatccgtgtggacgcggtggacaatgttagcgttgacatgctgcaactggtcagcagctacatgaaggcggcatacaaggtcaatgaatctgaagcccgtgcgctggcgaatatcagcattttggaagcgtggagccataatgacccgtattatgtgaacgagcacaatacggcagcactgagcatggataacggtctgcgtctgtctattgtgcatggtctgacgcgtccggtgactaacaaaggcacgggtgctcgtaacgccagcatgaaggacctgatcaacggcggttactttggcttgagcaaccgtgcggaagttactagctacgaccagctgggctttgccacttacctgtttgtgcgtgcgcatgacagcgaggttcagacggttatcgctgatattatttctaaaaagattgacccgaccaccgacggttttacctttaccctggaccagctgaagcaggcttttgatatttataacgcggacatgttgaaggttgataaagagtatacgcatagcaacatcccggctgcgtatgcgctgatgctgcaaacgatgggtgcagcgacccgcgtgtattacggcgatctgtacactgataacggccaatacatggcgaaaaagagcccgtattttgatcagattaccacgctgttgaaggcccgtccgaagtacgtggcgggtggccagacgagctacatccacaacctggcaggcgatggtgtcagctcggccaaagataacaaagaggttctggttagcgtgcgctacggtcaggatctgatgagcaaaacggatactgagggcggtaaatacggtcgtaacagcggtatgctgactctgatcgcgaacaacccggacctgaagctggccgatggtgagactatcacggttaacatgggtgctgcccacaaaaatcaggcgtatcgtccgttgctgctgggcacggaaaagggtattgtcagcagcctgaacgatagcgacaccaaaatcgtgaagtatacggacgcccaaggtaacctggttttcaccgccgacgagatcaagggcttcaaaaccgtggacatgtctggctacctgtctgtttgggttccggttggtgccacggatgaccagaacgtcctggcgaaaccgagcaccaaagcatacaaagaaggtgataaggtttacagcagcagcgcggctctggaagctcaggttatctatgaaggttttagcaatttccaggatttcgtgaaagaagatagccagtataccaataagctgattgcggctaatgcggacctgtttaagagctggggtatcacgagctttgagatcgcaccgcaatatgtgagcagcaaagatggtacttttctggacagcatcattgaaaatggttacgcgttcaccgatcgttatgacttcgcgatgagcaagaacaataagtatggtagcaaagaggatctgcgcgacgcgctgaaggcactgcacaaacaaggcatccaagtcatcgcggattgggtgccggatcagctgtataccctgccgggcaaagaggtggttacggcaacccgtaccgatacgcacggtaaagtgctggatgacacgagcctggtgaataaactgtatgtgaccaatacgaagtctagcggtaacgatttccaggcacagtatggtggtgcgttcctggataaactgcaaaagctgtacccagagattttcaaagaagttatggaagcgtccggcaagaccatcgacccaagcgtcaagattaaacaatgggaagctaaatactttaatggcacgaatattcaaaagcgtggttccgattatgttctgagcgatggcaaactgtactttacggttaacgataagggcaccttcctgcctgctgccctgacgggtgacaccaaggctaaaacgggttttgcctacgatggtacgggtgtcacgtattacactaccagcggtactcaagctaagagccagtttgtgacgtataatggtaagcaatactacttcaacgacaagggttacttggttaccggcgagcagacgattgatggctccaactatttcttcctgccgaatggtgttatgtttaccgatggtgtgcgtaaaaacgcgaagggtcagagcctggtttatggcaagtctggtaagctgaccacgcaaacgggctggaaagaagtgaccgttaaagatgatagcggcaaagaagaaaagttttaccagtatttcttcaagggtggcatcatggcgaccggcctgacggaagttgaaggtaaagagaagtatttctatgacaatggctaccaggctaaaggcgtctttgtcccgaccaaagacggccacctgatgttcttttgcggcgacagcggtgagcgtaaatacagcggtttctttgaacaagacggtaactggtactatgcgaatgacaagggctacgtcgcgaccggctttaccaaggtgggtaaacaaaatctgtatttcaatgagaaaggcgtccaggtcaaaaaccgctttttccaagtgggtgacgccacctattacgcgaataacgagggcgacgtgctgcgtggtgcgcaaaccatcaatggtgatgagctgtacttcgacgaaagcggcaaacaagttaagggtgagttcgtgaataacccagacggcacgacctcttactatgatgcgatcacgggcgttaagctggtcgatacctcgctggttgttgatggtcagacgttcaacgtggatgcgaagggtgtcgtaaccaaggcgcacacgccgggtttctacaccacgggcgacaacaactggttctacgcagatagctatggtcgtaatgttaccggtgcgcaagtaatcaacggccaacacctgtatttcgatgcaaatggtcgtcaagtgaaaggcggctttgtcacgaacacggacggtagccgtagcttttaccactggaataccggcgacaaactggtgtccacgttctttgcgacgggtcacgatcgctggtactacgctgatgatcgtggcaacgtcgtcacgggtgcacaggtcatcaacggtcagaagctgttctttgacaccgatggtaaacaagtcaaaggtgctttcgcgaccaacgcgaatggttcccgtagctattatcattggaatacgggcaacaagctggtgagcaccttcttcacctcgggtgacaataactggtattacgcggacgccaaaggtgaggttgtggtcggtgaacagacgattaatggccagcacctgtactttgaccagactggcaagcaagtgaagggcgcgactgcaacgaacccggacggctcgatcagctattatgatgtgcacacgggtgaaaaggctatcaatcgttgggtgaagattccgagcggtcaatgggtgtacttcaatgcgcagggcaaaggttacgtcagcaactaa

SEQ ID NO: 50 - protein, 1427 aa, Streptococcus salivarius
MKDGKYYYLLEDGSHKKNFAITVNGQVLYFDENGALSSTSTYSFTQETTNLVTDFTKNNAAYDSTKASFELVDGYLTADSWYRPKEILEAGTTWKASTEKDFRPLLMSWWPDKDTQVAYLNYMTKALSNGEETKDVFTIENSQASLNAAAQILQRKIEVKIAANKSTDWLRQSIEAFVKDQDKWNINSESPGKEHFQKGALLFVNSDSTKWANSDYRKLNQTATSYIKNHKIVNGSDGGYEFLLSNDIDNSNPVVQAEMLNQLYYFMNWGQIVFGDKDKDAHFDGIRVDAVDNVSVDMLQLVSSYMKAAYKVNESEARALANISILEAWSHNDPYYVNEHNTAALSMDNGLRLSIVHGLTRPVTNKGTGARNASMKDLINGGYFGLSNRAEVTSYDQLGFATYLFVRAHDSEVQTVIADIISKKIDPTTDGFTFTLDQLKQAFDIYNADMLKVDKEYTHSNIPAAYALMLQTMGAATRVYYGDLYTDNGQYMAKKSPYFDQITTLLKARPKYVAGGQTSYIHNLAGDGVSSAKDNKEVLVSVRYGQDLMSKTDTEGGKYGRNSGMLTLIANNPDLKLADGETITVNMGAAHKNQAYRPLLLGTEKGIVSSLNDSDTKIVKYTDAQGNLVFTADEIKGFKTVDMSGYLSVWVPVGATDDQNVLAKPSTKAYKEGDKVYSSSAALEAQVIYEGFSNFQDFVKEDSQYTNKLIAANADLFKSWGITSFEIAPQYVSSKDGTFLDSIIENGYAFTDRYDFAMSKNNKYGSKEDLRDALKALHKQGIQVIADWVPDQLYTLPGKEVVTATRTDTHGKVLDDTSLVNKLYVTNTKSSGNDFQAQYGGAFLDKLQKLYPEIFKEVMEASGKTIDPSVKIKQWEAKYFNGTNIQKRGSDYVLSDGKLYFTVNDKGTFLPAALTGDTKAKTGFAYDGTGVTYYTTSGTQAKSQFVTYNGKQYYFNDKGYLVTGEQTIDGSNYFFLPNGVMFTDGVRKNAKGQSLVYGKSGKLTTQTGWKEVTVKDDSGKEEKFYQYFFKGGIMATGLTEVEGKEKYFYDNGYQAKGVFVPTKDGHLMFFCGDSGERKYSGFFEQDGNWYYANDKGYVATGFTKVGKQNLYFNEKGVQVKNRFFQVGDATYYANNEGDVLRGAQTINGDELYFDESGKQVKGEFVNNPDGTTSYYDAITGVKLVDTSLVVDGQTFNVDAKGVVTKAHTPGFYTTGDNNWFYADSYGRNVTGAQVINGQHLYFDANGRQVKGGFVTNTDGSRSFYHWNTGDKLVSTFFATGHDRWYYADDRGNVVTGAQVINGQKLFFDTDGKQVKGAFATNANGSRSYYHWNTGNKLVSTFFTSGDNNWYYADAKGEVVVGEQTINGQHLYFDQTGKQVKGATATNPDGSISYYDVHTGEKAINRWVKIPSGQWVYFNAQGKGYVSN

SEQ ID NO: 51 - DNA, 4182 bp, Streptococcus sp. C150
atgatcaatggcaaacagtactatgtaaattcggacggtagcgtgcgtaagaatttcgtttttgaacaggatggtaagagctactactttgacgcggaaactggcgcgctggccactaaaagccaagatgaatttagcacggagccgattaaagcagcagtggacttctctagcggcaaccagctgtacaaaaatgacaacaaatcgctggatcagctggatacgtttatcaccgctgacgcatggtaccgccctaagtctattctgaaggatggcaaaacctggaccgcgtctaccgaagctgataagcgtccgttgctgatggtgtggtggccggacaagtccacccaagttaactacctgaactacatgcagaaccagggtttgggtgcgggtagcttcagcaccaatagcagccaagaatccctgaatctggctgcgaaagcagttcagaccaagatcgaagaacgcatcgcacgtgagggtaacaccaattggctgcgtaccagcattgaccaattcattaagacgcagccaggctggaacagcagcactgagaatagcagctatgatcacttgcagggtggtcaactgctgttcaataacagcaaaggtgatacgggtaaccgcaccagctatgcgaatagcgactatcgtctgctgaaccgtaccccaactaatcaaagcggcacccgtaagtactttaaggataattccatcggtggtctggaatttctgctggcaaacgacatcgacaacagcaaccctgccgttcaggcggagcagctgaactggctgcacttcatgatgaacattggttctatcatggcgaatgacccgacggcgaactttgatggtttgcgtgtggacgcgttggataacgtggatgcggacctgttgcagatcgcgagcgattacttcaaggcagtctacggtgttgataaatccgaggcgaatgcgatcaagcacctgagctatctggaggcgtggagcgccaatgacccgtattacaacaaggataccaaaggcgcgcaactgccgattgacaacgcgctgcgcaacgcactgaccaacctgttgatgcgtgacaagaatacgcgcatgcagctgggtgacatgacggcgtttatgaatagctctctgaacccacgtggtgcgaatgacaaaaacggcgagcgtatggcgaattacattttcacccgcgcacacgataccgaggcgcagaccatcattcagcgtattatccgcgatcgtatcaatccgaacctgtttggctacaatttcacccgcgatgaaatcaaaaaggcgtttgagatctacaacgcggacattaacacggcgcataagacgtacgcgagctacaatctgccgtccgtctacgcactgatgctgacgaataaggacagcgtgacccgtgtgtattacggtgacctgtatcgtgaggacggtcactacatggccaagaaaacgccttatttcgatgcaatcgataccctgctgcgtgcgcgcatcaaatacgtggcgggtggtcaagacatggaggtgaagaaagttggtaatgacggcttgctgacgagcgtccgctatggcaagggtgcgaacaatagcaccgactggggcacgactgaaacccgtacccaaggtatgggcgttatcctgacgaacaactatgatttccgcctgggcagcaacgaaaccgtcacgatgaacatgggccgtgcgcatcgcaatcagctgtatcgtccgctgctgctgacgaccaaggatggtctggccacgtacctgaatgatagcgacgtgccttcgaatttgctgaaacgcacggactggaatggtaacttgacctttaatgccaacgatgtgtttggtgtagagaacgtccaggtcagcggttacctgggtgtttgggtaccggttggtgctaaagctaaccaggatgcgcgtacccaaccgagcaaccgtgcgaacagcgatggtcaggtctataagtcgtctgcggcattggacagccaggtcatgtatgaggcgtttagcaattttcaggcatttgcggacgatcaaccggaactgtacatgaaccgcgttctggcgaagaacaccgatctgctgaaagcgtggggcgttactagcgttggcttgccgccacaatacgttagcagcaaagacggcaccttcctggatagcactattgataacggctatgcgttcgatgatcgttacgacatggcgctgagccagaacaacaaatacggttctctggaggacttgctgaacgttctgcgcgctctgcacaaagacggtattcaggcgattgcggactgggtcccggatcaaatctacaatttgccgggtaaagaggttgttaatgcgacgcgtgttaacggttacggttaccatcagcagggctaccagattgttgaccaggcgtacgttgcaaacacccgtacggatggtaccgattatcagggtcgttacggtggtgcttttctggacgaactgaaggcgaagtacccgagcattttcaatcgtgtccagattagcaacggtaaacagctgccaaccaatgagaaaatcacgaaatggtccgcgaaatacttcaatggcacgaacatcctgggccgtggtattaactatgtgctgcgcgacgacaagaccaatcagtatttcaacaccagcgcaaacggccaactgctgccgacgccactgcgcgacaccggtgccatcaccagcacgcaagttttccagcgtcgtggccaagacgtctattttctgcgtgataaccaggttatcaaaaacgagtttgtgcaagatggtaacggtaattggtactacttcggtgccgacggtaaaatgacgaagggtgcacaaaacatcaatagcaaggattactatttcttcgataatggcgtccagctgcgtaatgcgctgcgtcgcgcgtccaatggttacacctactattatggcctggacggtgccatgatcaagaacgctttcgtcgattttgatgataagcaccaacaggtgcgtgcgtttactacgcagggcacgatggtggtcggtaatttgcactggagcggtcaccacttctattttgaccgcgaaacgggtatccaagccaaagaccgcattgtgcgtaccgatgatggcaagctgcactattatgtcgcacaaaccggcgatatgggccgcaatgtgtttgcgaccgacagccgcacgggcaagcgctattactttgatgcggacggcaacaccgttacgggctcccgtgtcatcgacggcaagacctactacttcaaccaggacggttcggtcggtaccgcgtacagcaatcgtgcggatagcattatctttgagaatggcaaggctcgctatatcactccggctggcgagattggccgttccatttttgtctacaacccggcgaccaaagcgtggaattacttcgacaaggaaggtaaccgtgtcaccggtcgtcagtatattgacggcaatctgtactactttaaagaggacggctcccaagtgaaaggtgcgattgttgaagagaacggtatcaagtactactacgaaccgggcagcggtatcctggcgagcggtcgttatctgcaagtcggtgacgaccaatggatctacttcaaacacgacggtagcctggcgatcggtcaggttcgtgcagacggtggttacttgaaatactttgataagaatggcatccaggtcaagggccaaaccattgtggaggatggtcatacctattactacgatgccgactccggtgctctggtgacctctagcttcgcggagattgctccgaaccagtgggcctacttcaataccgagggccaagccctgaagggcaaatggaccatcaatggtaaagagtactattttgatcagaacggcattcagtataaaggcaaggcagttaaggtcggcagccgttacaaatactatgacgagaatgacggtcaaccggtcactaaccgttttgcccagattgagccgaacgtctgggcgtactttggtgccgatggctacgcagttactggcgaacaggtgattaatggccagcacctgtacttcgatcagtcgggtcgtcaggttaaaggtgcgtacgtcaccgtgaatggtcaacgtcgttactacgacgcaaacacgggtgaatacattccgggtcgttaa

SEQ ID NO: 52 - protein, 1393 aa, Streptococcus sp. C150
MINGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAVYGVDKSEANAIKHLSYLEAWSANDPYYNKDTKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADINTAHKTYASYNLPSVYALMLTNKDSVTRVYYGDLYREDGHYMAKKTPYFDAIDTLLRARIKYVAGGQDMEVKKVGNDGLLTSVRYGKGANNSTDWGTTETRTQGMGVILTNNYDFRLGSNETVTMNMGRAHRNQLYRPLLLTTKDGLATYLNDSDVPSNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGRYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGNGNWYYFGADGKMTKGAQNINSKDYYFFDNGVQLRNALRRASNGYTYYYGLDGAMIKNAFVDFDDKHQQVRAFTTQGTMVVGNLHWSGHHFYFDRETGIQAKDRIVRTDDGKLHYYVAQTGDMGRNVFATDSRTGKRYYFDADGNTVTGSRVIDGKTYYFNQDGSVGTAYSNRADSIIFENGKARYITPAGEIGRSIFVYNPATKAWNYFDKEGNRVTGRQYIDGNLYYFKEDGSQVKGAIVEENGIKYYYEPGSGILASGRYLQVGDDQWIYFKHDGSLAIGQVRADGGYLKYFDKNGIQVKGQTIVEDGHTYYYDADSGALVTSSFAEIAPNQWAYFNTEGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYIPGR

SEQ ID NO: 53 - DNA, 3789 bp, Leuconostoc citreum KM20
atgattaacggccacaattactatttcgacagcttgggtcaactgaagaaaggtttcacgggcgtgatcgacggtcaggtccgttacttcgaccaggagtccggtcaggaagttagcaccaccgacagccaaatcaaagagggcttgacgagccaaacgaccgactacaccgcccataacgcggtccacagcacggactccgcagattttgacaacttcaatggttacctgaccgcgagcagctggtatcgtcctaaggacgttctgcgtaacggccaacattgggaagccaccaccgcgaatgacttccgtcctatcgtcagcgtgtggtggccgagcaagcaaacgcaggtcaactacctgaactatatgagccagatgggtttgatcgataaccgtcaaatgttctcgttgaaagataaccaagcgatgctgaacatcgcgtgcacgaccgtgcaacaagcaatcgaaactaaaatcggtgtggcgaatagcaccgcgtggctgaaaaccgcgatcgatgactttatccgtacccagccgcagtggaacatgagcagcgaagatccgaagaatgaccatctgcaaaatggcgccctgacgtttgttaacagcccgctgaccccggatacgaatagcaatttccgcctgctgaatcgtaccccgaccaatcaaaccggtgttccgaaatacaccatcgaccaaagcaaaggtggttttgaactgctgctggcgaatgacgtggataattcgaacccggttgtgcaggccgagcagttgaactggctgcactacctgatgaactttggtagcattactgcgaatgacagcgcagcaaacttcgacggtattcgcgttgacgcagtggataacgtggatgcggacctgctgcaaattgcggcagattacttcaaagcagcatacggtgtggacaagaacgacgcaacggcaaatcagcatctgtcgatcctggaagattggagccacaacgacccggagtacgttaaagacttcggcaataaccaactgaccatggacgattacatgcacacgcagctgatctggagcctgacgaaagacatgcgtatgcgtggtacgatgcagcgctttatggactactatctggttaaccgcaatcacgacagcaccgagaatactgccattccgaattacagctttgtccgtgcccatgacagcgaagttcaaacggttattgcgcagatcatttctgagctgcatccagacgtgaagaatagcctggcgccgaccgcggatcaactggctgaggcgttcaaaatctacaacaacgacgagaagcaagctgataagaagtatacccaatacaatatgccaagcgcgtacgcaatgctgttgaccaataaagataccgttccgcgtgtttactacggtgacctgtataccgatgacggtcagtatatggctaacaaatccccgtattttgacgctatcaacggtctgctgaagagccgtatcaaatatgtggcaggcggtcaaagcatggcggtggatcagaatgatatcctgacgaatgtgcgctatggcaaaggtgccatgagcgtgacggatagcggcaacgcggatacgcgtacccagggcatcggcgttattgttagcaacaaagaaaacctggctctgaaatccggcgacaccgttaccctgcacatgggcgcagcgcacaagaaccaggcgtttcgcctgctgttgggtacgacggcggacaacctgagctactacgacaatgacaatgcgccggtgaagtacaccaatgatcaaggtgatctgattttcgataataccgagatttatggtgttcgcaatccgcaagtctctggttttctggcggtgtgggtcccggttggtgccgatagccatcaagatgctcgcactttgagcgacgatacggcacaccacgacggcaagaccttccactcgaacgcagcactggatagccaggtgatttacgaaggttttagcaacttccaagcatttgcaacgaatacggaagattacactaacgctgtgatcgccaaaaacggccagctgttcaaggattggggcatcacctcgttccagctggctccgcagtatcgcagctccaccgatacgagcttcctggatagcattattcagaacggctatgccttcacggaccgttatgacctgggctatggcaccccgacgaagtatggcaccgtggaccagctgcgcgatgcaatcaaggctctgcacgccaatggcatccaagcaattgccgactgggttccggaccagatctacaacctgccgggtcaggagctggccacggtgacccgtacgaactcctatggtgataaagacaccaatagcgatattgatcagagcttgtacgtgatccaatcgcgcggtggcggtaagtatcaagcccaatacggtggtgcattcctgagcgacattcaaaagaagtatccggctctgttcgagactaaacagatcagcacgggtctgccgatggacccgagccaaaagattaccgagtggagcggcaagtacttcaacggtagcaatattcaaggtaagggcgctggttacgtcctgaaggacagcggcaccgaccagtactataaagtgacgagcaacaataacaaccgtgatttcctgccgaaacagctgacggatgatctgtctgaaaccggttttgtgcgtgacaatattggcatggtctattacaccctgtctggctacctggcacgcaataccttcatccaggacgacaacggtaactattactactttgatagcaccggtcacctggttacgggtttccagaacattaacaaccaccactactttttcttgccgaacggcattgaactggttcagagctttctgcaaaacgctgatggtagcacgatctacttcgatcaaaagggtcgtcaagttttcaaccagtatatcactgatcagactggtaccgcgtactacttccagaacgacggcaccatggtcacttctggctttactgagatcgatggccacaagcagtatttctataagaatggcactcaggttaagggtcagtttgtgagcgacaccgatggtcacgtcttttacctggaagcgggtaatggtaatgtcgccacgcaacgtttcgcacagaacagccagggtcaatggttctacttgggtaatgatggcattgcgttgacgggtttgcagacgatcaacggtgttcagaactacttttatgcggacggtcatcaaagcaagggtgacttcatcaccatccagaatcatgtcctgtacaccaacccgctgacgggtgccatcacgaccggcatgcaacagatcggcgacaaaatcttcgtgtttgataatacgggtaatatgctgacgaaccagtattatcagacgctggatggtcagtggctgcacctgagcacccagggtccagcagatacgggtctggtcaatatcaatggtaatctgaagtattttcaggcaaatggtcgtcaggtgaaaggccaattcgtcaccgacccgattaccaacgtcagctactacatgaacgcgacggacggtagcgcagtgttcaatgactatttcacctatcagggccaatggtatttgacggactccaactatcagttggtcaaaggcttcaaagtggtgaacaacaaactgcaacatttcgatgaaatcaccggtgtgcaaaccaagagcgctcacattattgttaacaatcgtacctacatttttgacgaccagggctattttgtcagcgtggcataa

SEQ ID NO: 54 - protein, 1262 aa, Leuconostoc citreum KM20
MINGHNYYFDSLGQLKKGFTGVIDGQVRYFDQESGQEVSTTDSQIKEGLTSQTTDYTAHNAVHSTDSADFDNFNGYLTASSWYRPKDVLRNGQHWEATTANDFRPIVSVWWPSKQTQVNYLNYMSQMGLIDNRQMFSLKDNQAMLNIACTTVQQAIETKIGVANSTAWLKTAIDDFIRTQPQWNMSSEDPKNDHLQNGALTFVNSPLTPDTNSNFRLLNRTPTNQTGVPKYTIDQSKGGFELLLANDVDNSNPVVQAEQLNWLHYLMNFGSITANDSAANFDGIRVDAVDNVDADLLQIAADYFKAAYGVDKNDATANQHLSILEDWSHNDPEYVKDFGNNQLTMDDYMHTQLIWSLTKDMRMRGTMQRFMDYYLVNRNHDSTENTAIPNYSFVRAHDSEVQTVIAQIISELHPDVKNSLAPTADQLAEAFKIYNNDEKQADKKYTQYNMPSAYAMLLTNKDTVPRVYYGDLYTDDGQYMANKSPYFDAINGLLKSRIKYVAGGQSMAVDQNDILTNVRYGKGAMSVTDSGNADTRTQGIGVIVSNKENLALKSGDTVTLHMGAAHKNQAFRLLLGTTADNLSYYDNDNAPVKYTNDQGDLIFDNTEIYGVRNPQVSGFLAVWVPVGADSHQDARTLSDDTAHHDGKTFHSNAALDSQVIYEGFSNFQAFATNTEDYTNAVIAKNGQLFKDWGITSFQLAPQYRSSTDTSFLDSIIQNGYAFTDRYDLGYGTPTKYGTVDQLRDAIKALHANGIQAIADWVPDQIYNLPGQELATVTRTNSYGDKDTNSDIDQSLYVIQSRGGGKYQAQYGGAFLSDIQKKYPALFETKQISTGLPMDPSQKITEWSGKYFNGSNIQGKGAGYVLKDSGTDQYYKVTSNNNNRDFLPKQLTDDLSETGFVRDNIGMVYYTLSGYLARNTFIQDDNGNYYYFDSTGHLVTGFQNINNHHYFFLPNGIELVQSFLQNADGSTIYFDQKGRQVFNQYITDQTGTAYYFQNDGTMVTSGFTEIDGHKQYFYKNGTQVKGQFVSDTDGHVFYLEAGNGNVATQRFAQNSQGQWFYLGNDGIALTGLQTINGVQNYFYADGHQSKGDFITIQNHVLYTNPLTGAITTGMQQIGDKIFVFDNTGNMLTNQYYQTLDGQWLHLSTQGPADTGLVNINGNLKYFQANGRQVKGQFVTDPITNVSYYMNATDGSAVFNDYFTYQGQWYLTDSNYQLVKGFKVVNNKLQHFDEITGVQTKSAHIIVNNRTYIFDDQGYFVSVA

SEQ ID NO: 55 - DNA, 4284 bp, Streptococcus salivarius SK126
atgaaagacggcaagtactattacctgttggaggacggtagccacaagaaaaactttgcgatcacggtcaacggccaagtgctgtatttcgatgagaacggtgcactgagcagcacgtctacctattcgtttacccaggagactaccaacctggttaccgatttcactaagaataatgctgcgtacgacagcaccaaggcttccttcgagctggttgatggctacctgactgcggacagctggtatcgtccgaaggaaatcctggaggctggcaccacctggaaagcgagcaccgagaaagactttcgtccgctgctgatgagctggtggccggataaagacacccaggttgcgtacctgaattacatgacgaaggcgctgagcaatggcgaggaaacgaaagacgtgtttacgatcgagaactcccaagcatctctgaacgcagccgctcagatcatccaacgcaagatcgaggtcaagattgcagcgaacaaaagcacggactggctgcgccagagcatcgaggcgttcgtgaaagatcaagacaagtggaatatcaattcggagagcccgggtaaagagcatttccaaaaaggtgctctgctgttcgttaacagcgacctgaccaaatgggcgaatagcgactatcgtaaactggaccaaacggcgaccagccgtctgccgaaagacaagattaagagcggcagcgatgcgggctacgagtttttgctgtcctctgacattgataacagcaacccgattgttcaggcggagatgctgaaccaactgtactatttcatgaactggggtcagattgtgtttggcgacaaagataaggatgcccatttcgacggtatccgcgtcgacgccgtagacaacgttagcattgatatgctgcaactggttagctcttatatgaaggcggcatacaaagttaatgaaagcgaagcgcgtgcactggcaaacatttccattctggaggcttggagccagaacgatccgtactacgttgatgaacacaacacggctgcgctgtctatggacaacggtctgcgcctgagcatcgttcacggtttgacccgtccggttactaacaagggtaccggtgcccgtaatgcaagcatgaaagacctgatcaacggtggctacttcggcttgtccaatcgtgcagaagttacgagctacgatcagctgggcttcgccacctacctgtttgtgcgtgcccatgactctgaagttcagaccgttatcgcggacattatctcgaagaaaatcgatccaaccacggacggtttcacgttcaccctggaccagttgaaacaagccttcgacatctacaacgccgatatgctgaaggttgataaggagtacacgcacagcaacatcccggctgcgtatgccctgatgctgcaaactatgggtgcggctacgcgcgtgtattatggtgatttgtatacggacaatggccagtacatggcgaaaaagagcccgtactttgatcagatcacgaccctgctgaaggcgcgtagcaagtacgttgcgggtggccagaccagctacatccataacctggcgggtgatggtgtcagcagcgcgaaggataacaaagaggtgttggtcagcgtccgctacggtcaggatttgatgagcaaaaccgacaccgagggtggtaagtatggtcgtaacagcggtatgctgaccctgatcgccaacaaccctgatctgaagctggcagacggtgaaaccatcaccgtcaacatgggcgcagcgcacaagaatcaagcatatcgtccgttgttgctgggcaccgaaaagggcattgtgagcagcctgaatgattccgacacgaaaattgttaagtataccgacgcgcaaggcaatctggtttttaccgctgatgagatcaaaggtttcaaaaccgtggatatgagcggttacctgtccgtgtgggtgccggttggcgcgaccgaggaccaaaacgtgctggccaagccgagcacgaaggtctacaaagagggtgataaagtttattcgagcagcgcggcactggaagcacaggtgatctacgagggttttagcaattttcaagacttcgtgaaggaagatagccagtataccaacaagctgattgcggccaatgcggacctgttcaaaagctggggtattacgagctttgaaatcgctccgcagtatgttagctccaaggatggcaccttcctggatagcatcattgagaatggctacgcgtttaccgatcgttacgacttcgcgatgtcgaaaaacaataagtacggctccaaagaggatctgcgtgacgcgttgaaagccctgcacaaacaaggcattcaagttattgcagattgggtcccggaccagctgtacaccctgccgggtaaggaagtggtcacggcgacccgcacggacacccacggtaaagtcctggatgacacctccctggtcaataaactgtacgttaccaataccaaatctagcggtaacgacttccaggcgcaatacggcggtgcattcctggacaaactgcaaaagttgtacccggagattttcaaggaagtgatggaggctagcggcaaaaccattgatccgtccgtcaaaatcaagcagtgggaggcaaagtatttcaacggtacgaacattcagaaacgcggtagcgactacgttctgagcgacggcaaactgtatttcacggtaaacgacaaaggtaccttcttgccggcagctctgaccggtgacacgaaggcaaagaccggtttcgcctatgacggtactggcgtcacttactatacgacctccggcacgcaggcaaagagccaatttgtcacctacaatggcaagcagtactatttcaatgacaaaggttatctggtcacgggtgaacaggcgattgacggtagcaactacttcttcctgccgaacggcgttatgtttacggacggtgtgatcaaaaatgctaaaggtcagtctctggtctacggcaaatctggtaagctgaccacgcaaaccggttggaaggaagttacggtgaaggatgatagcggcaaggaagagaaattctaccaatacttctttaagggtggcattatggcgacgggtctgaccgaggttgaaggtaaagagaaatacttttatgataatggttatcaggctaaaggtattttcatccctaccaaagacggccatctgatgtttttctgcggtgatagcggtgagcgtaaatacagcggtttcttcgaacaagacggtaactggtattacgcaaacgataaaggttacgtcgcgaccggttttaccaaagtgggtaagcagaacttgtactttaacgagaaaggtgtgcaggtcaagaaccgtttctttcaggttggtgatgctacttattacgcgaataacgagggtgatgtactgcgtggtgcacagacgatcaacggcgacgaactgtacttcgacgaaagcggcaagcaagtcaaaggtgaatttgtgaataacccggacggtaccacgagctattatgacgcaattaccggtgtgaaactggtggacaccagcttggtcgttaatggtcaaacgttcaacattgacgctaaaggcgttgtcaccaaggcgcacacgccgggtttctataccactggcgacaacaattggttttatgcagatagccacggtcgcaatgtcactggcgcacagatcattaacggccaacacctgtatttcgatgcgaatggccgtcaggtgaagggcggctttgttatgaacactgatggttctcgttcgttctatcattggaataccggtgataaactggtgagcacgttctttacgaccggccacgatcgttggtactacgccgacgacaaaggtaacgtggtgaccggcgcacaagtcatcaacggtcagaaattgttcttcgcgaccgacggtaaacaagttaagggcgatttcgcgaccaacgcaaatggttcccgttcttactatcacggtgccacgggtaataagctggtcagcaccttctttaccacgggcgataacaactggtactatgcagacgcgaagggcgaggttgtcgttggtgaacaaacgattaacggtcaaaatctgtattttgatcagaccggtaagcaagtgaaaggtgcgaccgcgaccaatccagatggcagcatttcttattacgatgttcacacgggcgagaaggtcatcaaccgctgggtcaaaattccgagcggtcaatgggtgtacttcaacgcgcagggtaagggttacgtcagcaattaa

SEQ ID NO: 56 - protein, 1427 aa, Streptococcus salivarius SK126
MKDGKYYYLLEDGSHKKNFAITVNGQVLYFDENGALSSTSTYSFTQETTNLVTDFTKNNAAYDSTKASFELVDGYLTADSWYRPKEILEAGTTWKASTEKDFRPLLMSWWPDKDTQVAYLNYMTKALSNGEETKDVFTIENSQASLNAAAQIIQRKIEVKIAANKSTDWLRQSIEAFVKDQDKWNINSESPGKEHFQKGALLFVNSDLTKWANSDYRKLDQTATSRLPKDKIKSGSDAGYEFLLSSDIDNSNPIVQAEMLNQLYYFMNWGQIVFGDKDKDAHFDGIRVDAVDNVSIDMLQLVSSYMKAAYKVNESEARALANISILEAWSQNDPYYVDEHNTAALSMDNGLRLSIVHGLTRPVTNKGTGARNASMKDLINGGYFGLSNRAEVTSYDQLGFATYLFVRAHDSEVQTVIADIISKKIDPTTDGFTFTLDQLKQAFDIYNADMLKVDKEYTHSNIPAAYALMLQTMGAATRVYYGDLYTDNGQYMAKKSPYFDQITTLLKARSKYVAGGQTSYIHNLAGDGVSSAKDNKEVLVSVRYGQDLMSKTDTEGGKYGRNSGMLTLIANNPDLKLADGETITVNMGAAHKNQAYRPLLLGTEKGIVSSLNDSDTKIVKYTDAQGNLVFTADEIKGFKTVDMSGYLSVWVPVGATEDQNVLAKPSTKVYKEGDKVYSSSAALEAQVIYEGFSNFQDFVKEDSQYTNKLIAANADLFKSWGITSFEIAPQYVSSKDGTFLDSIIENGYAFTDRYDFAMSKNNKYGSKEDLRDALKALHKQGIQVIADWVPDQLYTLPGKEVVTATRTDTHGKVLDDTSLVNKLYVTNTKSSGNDFQAQYGGAFLDKLQKLYPEIFKEVMEASGKTIDPSVKIKQWEAKYFNGTNIQKRGSDYVLSDGKLYFTVNDKGTFLPAALTGDTKAKTGFAYDGTGVTYYTTSGTQAKSQFVTYNGKQYYFNDKGYLVTGEQAIDGSNYFFLPNGVMFTDGVIKNAKGQSLVYGKSGKLTTQTGWKEVTVKDDSGKEEKFYQYFFKGGIMATGLTEVEGKEKYFYDNGYQAKGIFIPTKDGHLMFFCGDSGERKYSGFFEQDGNWYYANDKGYVATGFTKVGKQNLYFNEKGVQVKNRFFQVGDATYYANNEGDVLRGAQTINGDELYFDESGKQVKGEFVNNPDGTTSYYDAITGVKLVDTSLVVNGQTFNIDAKGVVTKAHTPGFYTTGDNNWFYADSHGRNVTGAQIINGQHLYFDANGRQVKGGFVMNTDGSRSFYHWNTGDKLVSTFFTTGHDRWYYADDKGNVVTGAQVINGQKLFFATDGKQVKGDFATNANGSRSYYHGATGNKLVSTFFTTGDNNWYYADAKGEVVVGEQTINGQNLYFDQTGKQVKGATATNPDGSISYYDVHTGEKVINRWVKIPSGQWVYFNAQGKGYVSN

SEQ ID NO: 57 - DNA, 5208 bp, Lactobacillus reuteri
atggatcagcaagtacaaagcagcaccacccaggagcagacgagcacggttaacgcggacacgactaaaaccgtcaatctggataccaacactgaccagccggctcagacgaccgataagaatcaggtcgcgaatgataccaccaccaaccaaagcaagacggacagcaccagcacgacggttaagaatccgacgtttattcctgttagcactttgtccagctccgataacgaaaagcagagccagaattacaataaaccagataacggtaattacggtaatgttgatgcggcctacttcaataacaatcagctgcacattagcggttggcacgcaaccaacgcgagccagggtacggatagccgccaagtaatcgtacgcgacattaccaccaagaccgagctgggtcgtactaatgtgaccaacaatgttctgcgtccggacgtgaaaaatgttcacaacgtctacaacgctgacaacagcggctttgatgtgaatatcaatattgatttcagcaagatgaaagactatcgtgacagcatcgagatcgtttctcgttatagcggcaacggcaagagcgttgactggtggtcgcagccgatcacgtttgacaaaaacaattatgcttatctggacactttcgaggtgaagaacggtgaactgcatgcaacgggctggaatgccaccaacaaggctatcaattacaatcaccacttcgttattctgtttgatcgtacgaatggcaaagaagtcacccgccaagaggtgcgtgatggtcaaagccgtccggatgtggcgaaggtatacccgcaagtcgttggcgcgaacaatagcggttttgacgttacgtttaacattggtgatttggactacacccatcagtaccagatcctgtctcgttacagcaacgcagacaacggtgaaggcgattatgtgacctattggtttgcgccgcagagcatcgctccggcgaatcaaagcaaccaaggttacctggacagcttcgatatttcgaaaaacggtgaggtgaccgtgacgggttggaatgcgacggatctgagcgagttgcaaacgaatcactacgtgatcctgtttgatcagacggcgggtcaacaggttgcatccgctaaggtcgacctgatcagccgtccagacgtcgcgaaggcgtaccctaccgttaaaacggcagaaacctccggtttcaaggtcacgtttaaggttagcaatctgcaaccgggccaccaatacagcgtcgttagccgctttagcgccgatgaaaacggtaatggcaacgacaaacgccacacggactactggtactctccggttaccctgaaccaaacggctagcaacattgacactatcaccatgacttccaacggtctgcacatcaccggctggatggcgagcgataatagcattaacgaagcgaccccgtacgcgattatcctgaacaacggtcgcgaggtgacgcgccagaaactgaccctgatcgcgcgtccggatgttgcggcagtgtatccgagcctgtacaatagcgcggttagcggcttcgacaccaccatcaagctgactaacgcgcaatatcaagcattgaacggccagctgcaagtgctgctgcgctttagcaaggcggtggacggtaacccgaatggtaccaataccgtcacggatcaatttagcaaaaactacgcaacgaccggtggtaatttcgattacgtcaaggttaatggtaaccaaattgagttttctggctggcacgcgacgaatcagagcaatgataagaacagccaatggattatcgtcttggttaacggtaaagaggtcaaacgccagctggtcaatgacacgaaagacggcgcagccggcttcaatcgtaatgatgtgtataaagtgaacccagcgatcgaaaatagcattatgtctggcttccagggcattatcacgttgccggttacggtgaaagacgaaaacgtgcagctggtgcaccgcttctccaatgacgcaaaaacgggtgagggcaattatgtcgatttctggagcgaggtgatgtctgtgaaggactctttccaaaagggtaatggtccgctgaaccagtttggcctgcaaaccatcaacggccaacaatactatattgacccgacgaccggccagccgcgtaagaatttcctgctgcaaaacggcaacgattggatttacttcgacaaagacactggcgcaggcaccaacgcgctgaaattgcagtttgataagggcacgattagcgctgacgaacaataccgtcgcggcaacgaggcgtactcctacgatgataagagcattgaaaatgtcaacggttacttgacggcggacacgtggtaccgcccgaagcagatcctgaaggatggcaccacttggaccgattccaaagaaaccgatatgcgtccgatcttgatggtctggtggccaaacacggtgactcaggcgtactatctgaactacatgaaacaatatggcaatctgctgccggcgagcctgccgagctttagcaccgacgccgatagcgcggagttgaatcattattccgagctggtccaacagaatatcgagaaacgtattagcgagactggtagcactgattggctgcgtaccctgatgcacgagttcgtgacgaagaatagcatgtggaacaaagatagcgagaacgttgactacggtggcctgcaactgcaaggtggtttcctgaagtacgttaacagcgacctgacgaagtacgcaaactctgattggcgtctgatgaaccgtaccgcgacgaacattgacggtaagaattacggtggtgccgagtttctgctggcgaatgacatcgacaactctaacccggtggtgcaggccgaagaattgaattggctgtattatctgatgaacttcggtaccatcaccggtaacaacccagaagctaacttcgacggcatccgtgtcgacgcggtcgataatgtggatgttgatctgctgagcattgcccgtgactactttaatgcagcgtataacatggaacaaagcgatgctagcgcgaataagcacatcaatattctggaagattggggctgggacgatccggcgtacgtgaacaaaatcggcaatccacagttgaccatggatgaccgcctgcgtaatgcaattatggacaccctgagcggtgcgccggataagaaccaagcgctgaacaagctgattactcagtctctggtgaatcgcgcaaatgataatactgaaaacgcggtgatcccttcctacaactttgtccgcgctcatgacagcaatgcccaggaccagatccgtcaagcgatccaggcggcaaccggcaaaccttatggcgagttcaacttggatgatgagaaaaagggtatggaggcttacatcaatgaccaaaatagcaccaataagaaatggaacctgtacaacatgccgagcgcatataccatcctgctgacgaataaggactcggtcccgcgtgtctactatggcgacttgtaccaggatggtggccagtacatggaacacaaaactcgttactttgacaccatcacgaatctgctgaaaacccgcgtcaagtatgtcgcaggcggccagaccatgtctgtggataagaatggcattttgactaatgtccgtttcggtaagggtgcgatgaacgcaactgacacgggtaccgatgaaacccgcaccgaaggtatcggcgttgttatcagcaacaatacgaatttgaaactgaatgacggcgaaagcgttgtgctgcacatgggcgctgcccataagaatcagaagtatcgtgcagtgatcctgaccacggaggacggtgtgaagaattacaccaacgacaccgatgcgccggtcgcatacaccgacgcgaacggcgatttgcatttcaccaatactaacctggacggtcagcaatataccgccgttcgtggctacgcaaacccggacgttacgggttatctggccgtctgggttcctgctggtgccgccgatgaccaagacgcacgtaccgctccgagcgacgaggcccacaccacgaaaacggcgtatcgttccaatgcggcattggactccaacgtcatctacgaaggcttttcgaactttatctattggccgacgaccgagagcgagcgcacgaatgtccgcatcgcgcagaacgcggatctgttcaaatcgtggggtatcaccaccttcgagctggcgccacagtacaatagcagcaaggacggtacgtttctggattcgatcattgacaatggttacgcgtttaccgatcgttatgacctgggtatgtctaccccgaacaagtacggtagcgatgaggatctgcgtaacgccctgcaagcactgcacaaggccggtctgcaagccatcgcagattgggttccggaccaaatctacaatctgccgggcaaagaggctgtcacggttactcgtagcgatgaccacggcactacctgggaggttagcccgatcaagaatgtggtgtatatcactaataccatcggtggtggcgaataccagaaaaagtatggtggtgaatttctggacaccttgcaaaaagaatatccgcagctgtttagccaagtttacccggtgacccaaacgacgattgaccctagcgttaagattaaagagtggtccgcgaagtacttcaatggtactaatatcctgcatcgcggtgcgggttacgtcctgcgtagcaatgatggtaagtattacaacctgggtactagcacccagcagttcctgccgagccagctgagcgttcaagataatgagggttacggtttcgttaaagagggtaacaactatcactattatgacgagaacaaacaaatggttaaggacgcgtttatccaggatagcgtcggcaattggtactattttgataagaacggcaatatggttgcaaaccaaagcccggttgaaatcagcagcaacggtgcgagcggcacctacttgtttttgaataatggtaccagcttccgcagcggcctggtcaaaacggatgcaggcacctattactacgatggtgacggtcgcatggttcgtaatcaaacggtttctgacggtgccatgacgtacgttctggacgaaaatggtaaactggtcagcgaatcttttgatagcagcgcgaccgaggcccatccgctgaaaccgggcgatctgaacggtcaaaagtaa

SEQ ID NO: 58 - protein, 1735 aa, Lactobacillus reuteri
MDQQVQSSTTQEQTSTVNADTTKTVNLDTNTDQPAQTTDKNQVANDTTTNQSKTDSTSTTVKNPTFIPVSTLSSSDNEKQSQNYNKPDNGNYGNVDAAYFNNNQLHISGWHATNASQGTDSRQVIVRDITTKTELGRTNVTNNVLRPDVKNVHNVYNADNSGFDVNINIDFSKMKDYRDSIEIVSRYSGNGKSVDWWSQPITFDKNNYAYLDTFEVKNGELHATGWNATNKAINYNHHFVILFDRTNGKEVTRQEVRDGQSRPDVAKVYPQVVGANNSGFDVTFNIGDLDYTHQYQILSRYSNADNGEGDYVTYWFAPQSIAPANQSNQGYLDSFDISKNGEVTVTGWNATDLSELQTNHYVILFDQTAGQQVASAKVDLISRPDVAKAYPTVKTAETSGFKVTFKVSNLQPGHQYSVVSRFSADENGNGNDKRHTDYWYSPVTLNQTASNIDTITMTSNGLHITGWMASDNSINEATPYAIILNNGREVTRQKLTLIARPDVAAVYPSLYNSAVSGFDTTIKLTNAQYQALNGQLQVLLRFSKAVDGNPNGTNTVTDQFSKNYATTGGNFDYVKVNGNQIEFSGWHATNQSNDKNSQWIIVLVNGKEVKRQLVNDTKDGAAGFNRNDVYKVNPAIENSIMSGFQGIITLPVTVKDENVQLVHRFSNDAKTGEGNYVDFWSEVMSVKDSFQKGNGPLNQFGLQTINGQQYYIDPTTGQPRKNFLLQNGNDWIYFDKDTGAGTNALKLQFDKGTISADEQYRRGNEAYSYDDKSIENVNGYLTADTWYRPKQILKDGTTWTDSKETDMRPILMVWWPNTVTQAYYLNYMKQYGNLLPASLPSFSTDADSAELNHYSELVQQNIEKRISETGSTDWLRTLMHEFVTKNSMWNKDSENVDYGGLQLQGGFLKYVNSDLTKYANSDWRLMNRTATNIDGKNYGGAEFLLANDIDNSNPVVQAEELNWLYYLMNFGTITGNNPEANFDGIRVDAVDNVDVDLLSIARDYFNAAYNMEQSDASANKHINILEDWGWDDPAYVNKIGNPQLTMDDRLRNAIMDTLSGAPDKNQALNKLITQSLVNRANDNTENAVIPSYNFVRAHDSNAQDQIRQAIQAATGKPYGEFNLDDEKKGMEAYINDQNSTNKKWNLYNMPSAYTILLTNKDSVPRVYYGDLYQDGGQYMEHKTRYFDTITNLLKTRVKYVAGGQTMSVDKNGILTNVRFGKGAMNATDTGTDETRTEGIGVVISNNTNLKLNDGESVVLHMGAAHKNQKYRAVILTTEDGVKNYTNDTDAPVAYTDANGDLHFTNTNLDGQQYTAVRGYANPDVTGYLAVWVPAGAADDQDARTAPSDEAHTTKTAYRSNAALDSNVIYEGFSNFIYWPTTESERTNVRIAQNADLFKSWGITTFELAPQYNSSKDGTFLDSIIDNGYAFTDRYDLGMSTPNKYGSDEDLRNALQALHKAGLQAIADWVPDQIYNLPGKEAVTVTRSDDHGTTWEVSPIKNVVYITNTIGGGEYQKKYGGEFLDTLQKEYPQLFSQVYPVTQTTIDPSVKIKEWSAKYFNGTNILHRGAGYVLRSNDGKYYNLGTSTQQFLPSQLSVQDNEGYGFVKEGNNYHYYDENKQMVKDAFIQDSVGNWYYFDKNGNMVANQSPVEISSNGASGTYLFLNNGTSFRSGLVKTDAGTYYYDGDGRMVRNQTVSDGAMTYVLDENGKLVSESFDSSATEAHPLKPGDLNGQK

SEQ ID NO: 59 - protein, 1242 aa, Streptococcus sp. C150
MINGKEYYVEDDGTVRKNYVLERNGGSQYFNAETGELSNQKDYRFDKNGGTGSAADSTTNTNVTVNGDKNAFYGTTEKDIELVDGYFTANTWYRPKEILKDGKEWTASTENDKRPLLTVWWPSKAIQASYLNYMREEGLGTNQTFTSYSSQTQMDQAALEVQKRIEERIAREGNTDWLRTTIKNFVKTQPGWNSTSENLDNSDHLQGGALLYNNSNRTSYANSDYRLLNRTPTQQDGTRRYFKDNSSGGFEFLLANDIDNSNPAVQAEQLNWLHYIMNIGSLTGGSEDENFDGVRVDAVDNVNADLLQIASDYFKAKYGVEKSEEEAIKHLSILEAWSHNDAYYNEDTKGAQLPMDDPLRLAMVFSFLRPIGNRSGLEPLITNSLNDRSESKKNTKRMANYTFVRAHDSEVQSVIGQIIKNEINPQSTGNTFTLDEMKKAFKIYNADMRSANKRYTQYNIPSAYAFMLTNKDTVPRVYYGDLYTDDGQYMAQKSPYHDAISTLLQARIRYAAGGQDMKMSYVGSGNTNGWDASGVLTSVRYGKGANNASDAGTAETRNQGMAVILSNQPALRLNSNLTINMGAAHRNQAYRPLLLTTSNGVASYLNDGDANGIVKYTDANGYLTFNPGEISGVRNAQVDGYLAVWVPLGASENQDVRVAASKSKNSSGLVYDSSAALDSQVIYEGFSNFQDFVQDPSQYTNKKIAENANLFKSWGITSFEFAPQYVSSDDGTFLDSVIQNGYAFSDRYDIGMSKDNKYGSLADLKAALKSLHAVGISAIADWVPDQIYNLPGDEVVTATRVNNYGETKDGAIIDHSLYVAKTRTFGNDYQGKYGGAYLDELKRLYPQFFDRVQISTGKRLTTDEKITKWSAKYMNGTNILDRGSEYVLKNGLSGYYGTNGGKVSLPKVVGSNQSTNNNNQNGDGSGRFEKSWGSVYYRYNDGQRARNAFIKDNDGNVYYFDNTGRMAIGEKTIDGKQYFFLANGVQLRDGYRQNRRGQVFYYDENGIMSQTGKPSPKPEPKPDNNTFSRNQFIQIGNNVWAYYDGNGKRVIGRQNINGQELFFDNNGVQVKGRTAQVDGVTRYFDANSGEMARNRFAEVEPGVWAYFNNDGAAVTGSQNINGQTLYFDQNGHQVKGALVTVDGNLRYYDANSGDLYRNRFQEVNGSWYYFDGNGNAVKGMVNINGQNLLFDNDGKQVKGHLVRVNGVIRYYDPNSGEMAVNRWVEISSGWWVYFDGEGRGQI

SEQ ID NO: 60 - protein, 1518 aa, Streptococcus salivarius
MENKIHYKLHKVKKQWVTIAVASVALATVLGGLSVTTSSVSADETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 61 - protein, 1528 aa, Streptococcus salivarius K12
MTNKITGKIIMENKVHYKLHKVKKQWVTIAVASAALATVVGGLSATTSSVSADETQDKIVTQPNLDTTADLVTSTEATKEVDKRTNTKEADVLTPAKETNAVETATTTNTQATAEAATTATTSDVAVAAVPNKEAVVTTDAPAVTTEKAEEQPATVKAEVVNTEVKAPQAALKDSEVEAALSLKNIKYTDGKYYYVNEDGSHKENFAITVNGQLLYFGKDGALTSSSTHSFTPGTTNIVDGFSINNRAYDSSEASFELINGYLTADSWYRPVSIIKDGVTWQASTAEDFRPLLMAWWPNVDTQVNYLNYMSKVFNLEAKYTSTDKQADLNRAAKDIQVKIEQKIQAEKSTQWLRETISAFVKTQPQWNKETENYSKGGGEDHLQGGALLYVNDSRTPWANSNYRLLNRTATNQTGTINKSVLDEQSDPNHMGGFDFLLANDVDLSNPVVQAEQLNQIHYLMNWGSIVMGDKDANFDGIRVDAVDNVNADMLQLYTNYFREYYGVNKSEAQALAHISVLEAWSLNDNHYNDKTDGAALAMENKQRLALLFSLAKPIKDRTPAVSPLYNNTFNTTQRDFKTDWINKDGSTAYNEDGTAKQSTIGKYNEKYGDASGNYVFIRAHDNNVQDIIAEIIKKEINKKSDGFTISDSEMKQAFEIYNKDMLSSNKKYTLNNIPAAYAVMLQNMETITRVYYGDLYTDDGHYMETKSPYHDTIVNLMKNRIKYVSGGQAQRSYWLPTDGKMDNSDVELYRTSEVYTSVRYGKDIMTADDTEGSKYSRTSGQVTLVVNNPKLTLHESAKLNVEMGKIHANQKYRALIVGTADGIKNFTSDAEAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGRDYQAQYGGEFLAELKAKYPKMFTENMISTGKPIDDSVKLKQWKAKYFNGTNVLDRGVGYVLSDEATGKYFTVTKEGNFIPLQLTGNEKAVTGFSNDGKGITYFGTSGNQAKSAFVTFNGNTYYFDARGHMVTNGEYSPNGKDVYRFLPNGIMLSNAFYVDANGNTYLYNYKGQMYKGGYTKFDVTETDKDGNESKVVKFRYFTNEGVMAKGLTVIDGSTQYFGEDGFQTKDKLATYKGKTYYFEAHTGNAIKNTWRNIDGKWYHFDENGVAATGAQVINGQKLYFNEDGSQVKGGVVKNADGTYSKYKEGSGELVTNEFFTTDGNVWYYAGADGKTVTGAQVINGQHLYFKEDGSQVKGGVVKNADGTYSKYDAATGERLTNEFFTTGDNNWYYIGSNGKTVTGEVKIGADTYYFAKDGKQVKGQTVTAGNGRISYYYGDSGKKAISTWIEIQPGIYVYFDKTGIAYPPRVLN

SEQ ID NO: 62 - protein, 1518 aa, Streptococcus salivarius SK126
MENKIHYKLHKVKKQWVTIAVASVALATVLGGLSVTTSSVSADETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLTLDQSAKLNVEMGKIHANQKYRALIVGTADGIKNFTSDADAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANTKSSGKDYQAKYGGEFLAELKAKYPEMFKVNMISTGKPIDDSVKLKQWKAEYFNGTNVLERGVGYVLSDEATGKYFTVTKDGNFIPLQLTGNEKVVTGFSNDGKGITYFGTSGTQAKSAFVTFNGNTYYFDARGHMVTNGEYSPNGKDVYRFLPNGIMLSNAFYVDANGNTYLYNSKGQMYKGGYTKFDVTETDKDGKESKVVKFRYFTNEGVMAKGVTVIDGFTQYFGEDGFQAKDKLVTFKGKTYYFDAHTGNAIKDTWRNINGKWYHFDANGVAATGAQVINGQKLYFNEDGSQVKGGVVKNADGTYSKYKEGSGELVTNEFFTTDGNVWYYAGANGKTVTGAQVINGQHLYFNADGSQVKGGVVKNADGTYSKYDASTGERLTNEFFTTGDNNWYYIGANGKSVTGEVKIGDDTYFFAKDGKQVKGQTVSAGNGRISYYYGDSGKRAVSTWIEIQPGVYVYFDKNGIAYPPRVLN

SEQ ID NO: 63 - protein, 1431 aa, Streptococcus salivarius PS4
MTKETNTVDAATTTNTQAAADAATKTADAAVTALPNKEAVVTTDAPAVTTEKAAEQPATVKSEVVNTEVKAPEAALKDSEVEAALSLKNIKNIDGKYYYVNKDGSHKENFAITVNGQLLYFGKDGALTSSSTYSFTQGTTNIVDGFSKNNRAYDSSEASFELIDGYLTADSWYRPVSIIKDGVTWQASTKEDFRPLLMAWWPNVDTQVNYLNYMSKVFNLDAKYTSTDKQVDLNRAAKDIQVKIEQKIQAEKSTQWLREAISAFVKTQPQWNKETENFSKGGGEDHLQGGALLYVNDPRTPWANSNYRLLNRTATNQTGTIDKSVLDEQSDPNHMGGFDFLLANDVDTSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKKAFEIYNKDMLSSDKKYTLNNIPAAYAVMLQNMETITRVYYGDLYTDDGHYMETKSPYYDTIVNLMKNRIKYVSGGQAQRSYWLPTDGKMDKSDVELYRTNEVYTSVRYGKDIMTADDTQGSKYSRTSGQVTLVVNNPKLSLDKSAKLDVEMGKIHANQKYRALIVGTPNGIKNFTSDAEAIAAGYVKETDGNGVLTFGANDIKGYETFDMSGFVAVWVPVGASDDQDIRVAASTAAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRNALKALHKAGIQAIADWVPDQIYQLPGKEVVTATRTDGAGRKISDAIIDHSLYVANSKSSGKDYQAKYGGEFLAELKAKYPEMFKVNMISTGKPIDDSVKLKQWKAEYFNGTNVLDRGVGYVLSDEATGKYFTVTKEGNFIPLQLKGNEKVITGFSSDGKGITYFGTSGNQAKSAFVTFNGNTYYFDARGHMVTNGEYSPNGKDVYRFLPNGIMLSNAFYVDGNGNTYLYNSKGQMYKGGYSKFDVTETKDGKESKVVKFRYFTNEGVMAKGVTVVDGFTQYFNEDGIQSKDELVTYNGKTYYFEAHTGNAIKNTWRNIKGKWYHFDANGVAATGAQVINGQHLYFNEDGSQVKGGVVKNADGTFSKYKDGSGDLVVNEFFTTGDNVWYYAGANGKTVTGAQVINGQHLFFKEDGSQVKGDFVKNSDGTYSKYDAASGERLTNEFFTTGDNHWYYIGANGKTVTGEVKIGDDTYFFAKDGKQLKGQIVTTRSGRISYYFGDSGKKAISTWVEIQPGVFVFFDKNGLAYPPENMN

SEQ ID NO: 64 - protein, 1532 aa, unknown
  unknown Streptococcus sp. C150
MENKVHYKLHKVKKQWVTIAVASAALATVVGGLSATTSSVSADETQDKTVTQPNSDTTADLVTSTEATKEVDKRTNTKEADVLTPAKETNTVETAATTNTQATAEAAKTATTTNTQATAEVAKTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTQGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSNYRLLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDVAALAMENKQRLALLFSLAKPIKERTPAVSPLYNNTFNTTQRDEKTDWINKDGSKAYNEDGTVKKSTIGKYNEKYGDASGNYVFIRAHDNNVQDIIAEIIKKEINEKSDGFTITDSEMKRAFEIYNKDMLSNDKKYTLNNIPAAYAVMLQNMETITRVYYGDLYTDDGNYMEAKSPYYDTIVNLMKSRIKYVSGGQAQRSYWLPTDGKMDKSDVELYRTNEVYTSVRYGKDIMTADDTQGSKYSRTSGQVTLVVNNPKLTLDQSAKLNVVMGKIHANQKYRALIVGTPNGIKNFTSDAEAIAAGYVKETDGNGVLTFGANDIKGYETFDMSGFVAVWVPVGASDDQDIRVAASTAAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRNALKALHKAGIQAIADWVPDQIYQLPGKEVVTATRTDGAGRKISDAIIDHSLYVANSKSSGKDYQAKYGGEFLAELKAKYPEMFKVNMISTGKPIDDSVKLKQWKAEYFNGTNVLDRGVGYVLSDEATGKYFTVTKEGNFIPLQLKGNKKVITGFSSDGKGITYFGTSGNQAKSAFVTFNGNTYYFDARGHMVTNGEYSPNGKDVYRFLPNGIMLSNAFYVDGNGNTYLYNSKGQMYKGGYSKFDVTETKDGKESKVVKFRYFTNEGVMAKGVTVVDGFTQYFNEDGIQSKDELVTYNGKTYYFEAHTGNAIKNTWRNIKGKWYHFDANGVAATGAQVINGQHLYFNEDGSQVKGSIVKNADGTFSKYKDSSGDLVVNEFFTTGDNVWYYAGANGKTVTGAQVINGQHLFFKEDGSQVKGDFVKNSDGTYSKYDAASGERLTNEFFTTGDNHWYYIGANGKTVTGEVKIGDDTYFFAKDGKQLKGQIVTTRSGRISYYFGDSGKKAISTWVEIQPGVFVFFDKNGLAYPPENMN

SEQ ID NO: 65 - protein, 1341 aa, Streptococcus salivarius
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 66 - protein, 906 aa, Artificial sequence
  6855 gtf catalytic domain with corresponding A510E substitution
FSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEEWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLTLDQSAKLNVEMGKIHANQKYRALIVGTADGIKNFTSDADAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANTKSSGKDYQAKYGGEFLAELKAKYPEMFKVNMISTGKPIDDSVKLKQWKAEYFNGTNVLERGVGYVLSDEATGKYFTVTKDGNFIPLQLTGNEKVVTG

SEQ ID NO: 67 - DNA, 93 bp, Unknown
  terminator sequence added to pHYT
ggttaccttgaatgtatataaacattctcaaagggatttctaataaaaaacgctcggttgccgccgggcgttttttatgcatcgatggaattc

SEQ ID NO: 68 - protein, 1338 aa, Streptococcus criceti
MEKNLRYKLHKVKKQWVAIGVTTFAVGFLAGGQVVAADATDGNGGNTQVAHLIPKEPTDYKFDTPSGILTGLNFANAQTSPAGDNAGANQPAGGIEPQTAENAATDGQAVPQTSDQPGHLENVDGKTYYVDANGQRLKNYSTVIDGKTYYFDAQTGQAQAETPQINQNDNQVAPDTYAANNQAFTNDVSSFETVDNYVTADSWYRPRKILKNGESWQASAESDMRPILMTWWPDAATKAAYANYWVKEGLISGSYSPNSANLETAVQTIQAAIEKKIASEGSTAWLRDKMSQFVKSQNQWSLASENPTVYPNQDHLQGGALLFSNNEATAHANSDWRLLNRNPTFQTGKQKYFTTNYAGYELLLANDVDNSNPIVQAEQLNHFHYLMNWGEIVMGDKNANFDGVRVDAVDNVNADLLQIQRDYYKAKYGVDQNEKNAIDHLSILEAWSGNDNDYVKDQNNFSLSIDNSQRSYMLAAFAYPASQRGNDYISLLPKVGLKDRRYAKNGNPVPNYVFIRAHDSEVQTRIAKIIRERLGKTNADGLTNITLDDLNKAFDIYNQDMKAVDKQYYPNNLPMAYAWMLQNKDTVTRVYYGDMYTDDGQYMETKTPFHDAIETLLKARIKYVAGGQTAGYVQGWGSGILTSVRYGKGADTAIDAGTAETRTSGMAVLINNKPNFQSYNGLTLDMGAAHKNQAYRPLLLSTKDGIATYLNDSDVSSNQYKYTDGQGRLNFSASELRSVANVQVSGMIQVWVPVGAADNQDVRVAPNTNRNNSSNIYTQSDALDSQVIYEGFSNFQAFAKTPEQYTNAVIAKNADLFKSWGITQFEMAPQYVSSEDGTFLDSVVLNGYAFSDRYDLAMSKNNKYGSKEDLANAIKGLHNAGIKVLSDWVPDQMYNLPGKEVVTATRVDQYGRPKAGATINRTPYVVNTKTYGDYQEQYGGKFLDELQKLYPSLFTTKQISTGKPIDPSVKITNWSAKYFNGSNILGRGAKYVLSDNNKYLNLGAGQFFLPTNLNNTYGQPQAPANGFISKNGGIHYIDNNGQEVKNQFKEIAGSWYYFDANGKMATGQTKIGNTTYLFMPNGKQLKEGVWYDGKKAYYYDDNGRTWTNKGFVEFKVNGQDKWRYFNGDGSIAVGLVSLDNRTLYFDAYGYQVKGQTLTINGKTYSFDANEGDLITGNTPSPEPNNQGAWEALGDNQWGYRKDGKLLTGSQTIAGQKVFFQPNGVQVKGGTAKDEAGVLRFYDRDQGHLAGKGWYSTADNNWVYVDDAGRVVTGLQKIGSQTLYFDDNGIQAKGKAIWDKDGNLRYFAAGSGDMITNRWYNIGDNQWYWFNNQGIASRW

SEQ ID NO: 69 - protein, 1554 aa, Streptococcus sobrinus
MEKKLHYKLHKVKKHWVTIAVASIGLVSLVGAGTVSAEDKVANDTTAQATVGVDTGQDQATTNDANTNTTDTDTADQSANTNQDQAGSDQSNNQDQAKQDTANTDRNQADNSQTDNNQATDQATSPATDGTSVQRRDAANVATAADQEGQTAPSEQEKSAALSLDNVKLIDGKYYYVQADGSYKKNFAITVNGQMLYFDSDTGALSSTSTYSFSQGTTNLVDDFSSHNKAYDSTAKSFELVNGYLTANSWYRPAGILRNGQTWEASNENDLRPVLMSWWPDKDTQVAYVNYMNKYLSANETEVTNETSQVDLNKEAQSIQTKIEQKITSDNSTQWLRTAMEAFVAAQPKWNMSTENFNKGDHLQGGALLYTNSDLTPWANSDYRLLNRTPTQQDGTKKYFTEGGEGGYEFLLSNDVDNSNPVVQAEQLNQLHYLMNWGDIVMGDKDANFDGVRVDAVDNVNADLLQVYSNYFKDNYKVTDSEANALAHISILEAWSLNDNQYNEDTNGTALSIDNSSRLTSLAVLTKQPGQRIDLSNLISESVNKERANDTAYGDTIPTYSFVRAHDSEVQTVIAKIVKEKIDTNSDGYTFTLDQLKDAFKIYNEDMAKVNKTYTHYNIPAAYALLLSNMESVPRVYYGDLYTDDGQYMAKKSPYYDAIATMLQGRIAYVSGGQSEEVHKVNGNNQILSSVRYGQDLMSADDTQGTDLSRTSGLVTLVSNDPNLDLGGDSLTVNMGRAHANQAYRPLILGTKDGVQSYLKDSDTNIVKYTDANGNLTFTADDIKGYSTVDMSGYLAVWVPVGAKDGQDVRVAADTNQKADGKSLKTSAALDSQVIYEGFSNFQDFANNDADYTNKKIAENADFFKKLGITSFEMAPQYVSATDGSFLDSIIQNGYAFSDRYDLAMSKNNKYGSKDDLANALKALHANGIQAIADWVPDQIYQLPGEEVVTAKRTNSYGNPTFDAYINNALYATNTKSSGSDYQAQYGGAFLDELKAKYPDMFTVNMISTGKPIDPSTKIKQWEAKYFNGTNVLGKGAGYVLSDDATGKYFTVNENGDFLPASFTGDQNAKTGFYYDGTGMAYYSTSGNKAVNSFIYEGGHYYYFDKDGHMVTGSYKAEDGNDYYFLPNGIQMRDAIYQDAQGNSYYYGRTGILYKGDNWYPFVDPNNANKTVFRYFDANNVMAIGYRNMYGQTYYFDENGFQAKGQLLTDDKGTHYFDEDNGAMAKNKFVNVGDDWYYMDGNGNAVKGQYPVNNQILYFNPETGVQVKGQFITDAQGRTSYYDANSGALKSSGFFTPNGSDWYYAENGYVYKGFKQVAENQDQWYYFDQTTGKQAKGAAKVDGRDLYFNPDSGVQVKGDFATDESGNTSFYHGDNGDKVVGGFFTTGNNAWYYADNNGNLVKGFQEIDGKWYHFDEVTGQQAKGAALVNGQQLYFDVDSGIQVKGDFVTDGQGNTSYYDVNSGDKKVNGFFTTGDNAWYYADGQGNLAKGRKSIDNQDLYFDPATGKQVKGQLVSIDGRNYYFDSGSGNMAKNRFVRIGDQWIYFGNDGAATNL

SEQ ID NO: 70 - protein, 1414 aa, Artificial sequence
  N-terminal truncated 8845 gtf protein
MRSKKLWISLLFALTLIFTMAFSNMSASAIDGKYYYVQADGSYKKNFAITVNGQMLYFDSDTGALSSTSTYSFSQGTTNLVDDFSSHNKAYDSTAKSFELVNGYLTANSWYRPAGILRNGQTWEASNENDLRPVLMSWWPDKDTQVAYVNYMNKYLSANETEVTNETSQVDLNKEAQSIQTKIEQKITSDNSTQWLRTAMEAFVAAQPKWNMSTENFNKGDHLQGGALLYTNSDLTPWANSDYRLLNRTPTQQDGTKKYFTEGGEGGYEFLLSNDVDNSNPVVQAEQLNQLHYLMNWGDIVMGDKDANFDGVRVDAVDNVNADLLQVYSNYFKDNYKVTDSEANALAHISILEAWSLNDNQYNEDTNGTALSIDNSSRLTSLAVLTKQPGQRIDLSNLISESVNKERANDTAYGDTIPTYSFVRAHDSEVQTVIAKIVKEKIDTNSDGYTFTLDQLKDAFKIYNEDMAKVNKTYTHYNIPAAYALLLSNMESVPRVYYGDLYTDDGQYMAKKSPYYDAIATMLQGRIAYVSGGQSEEVHKVNGNNQILSSVRYGQDLMSADDTQGTDLSRTSGLVTLVSNDPNLDLGGDSLTVNMGRAHANQAYRPLILGTKDGVQSYLKDSDTNIVKYTDANGNLTFTADDIKGYSTVDMSGYLAVWVPVGAKDGQDVRVAADTNQKADGKSLKTSAALDSQVIYEGFSNFQDFANNDADYTNKKIAENADFFKKLGITSFEMAPQYVSATDGSFLDSIIQNGYAFSDRYDLAMSKNNKYGSKDDLANALKALHANGIQAIADWVPDQIYQLPGEEVVTAKRTNSYGNPTFDAYINNALYATNTKSSGSDYQAQYGGAFLDELKAKYPDMFTVNMISTGKPIDPSTKIKQWEAKYFNGTNVLGKGAGYVLSDDATGKYFTVNENGDFLPASFTGDQNAKTGFYYDGTGMAYYSTSGNKAVNSFIYEGGHYYYFDKDGHMVTGSYKAEDGNDYYFLPNGIQMRDAIYQDAQGNSYYYGRTGILYKGDNWYPFVDPNNANKTVFRYFDANNVMAIGYRNMYGQTYYFDENGFQAKGQLLTDDKGTHYFDEDNGAMAKNKFVNVGDDWYYMDGNGNAVKGQYPVNNQILYFNPETGVQVKGQFITDAQGRTSYYDANSGALKSSGFFTPNGSDWYYAENGYVYKGFKQVAENQDQWYYFDQTTGKQAKGAAKVDGRDLYFNPDSGVQVKGDFATDESGNTSFYHGDNGDKVVGGFFTTGNNAWYYADNNGNLVKGFQEIDGKWYHFDEVTGQQAKGAALVNGQQLYFDVDSGIQVKGDFVTDGQGNTSYYDVNSGDKKVNGFFTTGDNAWYYADGQGNLAKGRKSIDNQDLYFDPATGKQVKGQLVSIDGRNYYFDSGSGNMAKNRFVRIGDQWIYFGNDGAATNL

SEQ ID NO: 71 - protein, 906 aa, Artificial sequence
  6855 gtf catalytic domain with corresponding A510D substitution
FSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEDWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLTLDQSAKLNVEMGKIHANQKYRALIVGTADGIKNFTSDADAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANTKSSGKDYQAKYGGEFLAELKAKYPEMFKVNMISTGKPIDDSVKLKQWKAEYFNGTNVLERGVGYVLSDEATGKYFTVTKDGNFIPLQLTGNEKVVTG

What is claimed is:

1. A non-native glucosyltransferase comprising at least one amino acid substitution at a position corresponding with amino acid residue Ala-510 of SEQ ID NO:62
   wherein the non-native glucosyltransferase synthesizes alpha-glucan comprising 1,3-linkages, and
   wherein the non-native glucosyltransferase has:
   (i) an alpha-glucan yield that is higher than the alpha-glucan yield of a second glucosyltransferase that only differs from the non-native glucosyltransferase at the substitution position(s), and/or
   (ii) a leucrose yield that is lower than the leucrose yield of the second glucosyltransferase;
   wherein the non-native glucosyltransferase comprises a catalytic domain that is at least about 90% identical to residues 55-960 of SEQ ID NO:4, residues 54-957 of SEQ ID NO:65, residues 55-960 of SEQ ID NO:30, residues 55-960 of SEQ ID NO:28, or residues 55-960 of SEQ ID NO:20.

2. The non-native glucosyltransferase of claim 1, wherein the amino acid substitution at the position corresponding with amino acid residue Ala-510 is with a Glu, Ile, Val, or Asp residue.

3. The non-native glucosyltransferase of claim 1, comprising two or more amino acid substitutions.

4. The non-native glucosyltransferase of claim 3, wherein one of the two or more amino acid substitutions is at a position corresponding with amino acid residue Phe-607 of SEQ ID NO:62.

5. The non-native glucosyltransferase of claim 1, wherein the alpha-glucan is insoluble and comprises at least about 50% alpha-1,3 linkages, and optionally wherein the alpha-glucan has a weight average degree of polymerization ($DP_w$) of at least 100.

6. The non-native glucosyltransferase of claim 1, comprising a catalytic domain that is at least about 92% identical to residues 55-960 of SEQ ID NO:4, residues 54-957 of SEQ ID NO:65, residues 55-960 of SEQ ID NO:30, residues 55-960 of SEQ ID NO:28, or residues 55-960 of SEQ ID NO:20.

7. The non-native glucosyltransferase of claim 1, comprising an amino acid sequence that is at least about 90% identical to SEQ ID NO:4, SEQ ID NO:65, SEQ ID NO:30, SEQ ID NO:28, or SEQ ID NO:20.

8. The non-native glucosyltransferase of claim 5, wherein the non-native glucosyltransferase synthesizes insoluble alpha-1,3-glucan having at least about 90% alpha-1,3-linkages.

9. The non-native glucosyltransferase of claim 7, comprising an amino acid sequence that is at least about 92% identical to SEQ ID NO:4, SEQ ID NO:65, SEQ ID NO:30, SEQ ID NO:28, or SEQ ID NO:20.

10. The non-native glucosyltransferase of claim 1, wherein the alpha-glucan yield is at least about 10% higher than the alpha-glucan yield of the second glucosyltransferase.

11. A reaction composition comprising water, sucrose, and a non-native glucosyltransferase according to claim 1.

12. A method of producing alpha-glucan comprising:
(a) contacting at least water, sucrose, and a non-native glucosyltransferase enzyme according to claim 1, whereby alpha-glucan is produced; and
(b) optionally, isolating the alpha-glucan produced in step (a).

13. The non-native glucosyltransferase of claim 6, comprising a catalytic domain that is at least about 93% identical to residues 55-960 of SEQ ID NO:4, residues 54-957 of SEQ ID NO:65, residues 55-960 of SEQ ID NO:30, residues 55-960 of SEQ ID NO:28, or residues 55-960 of SEQ ID NO:20.

14. The non-native glucosyltransferase of claim 13, comprising a catalytic domain that is at least about 95% identical to residues 55-960 of SEQ ID NO:4, residues 54-957 of SEQ ID NO:65, residues 55-960 of SEQ ID NO:30, residues 55-960 of SEQ ID NO:28, or residues 55-960 of SEQ ID NO:20.

15. The non-native glucosyltransferase of claim 14, comprising a catalytic domain that is at least about 96% identical to residues 55-960 of SEQ ID NO:4, residues 54-957 of SEQ ID NO:65, residues 55-960 of SEQ ID NO:30, residues 55-960 of SEQ ID NO:28, or residues 55-960 of SEQ ID NO:20.

16. The non-native glucosyltransferase of claim 15, comprising a catalytic domain that is at least about 97% identical to residues 55-960 of SEQ ID NO:4, residues 54-957 of SEQ ID NO:65, residues 55-960 of SEQ ID NO:30, residues 55-960 of SEQ ID NO:28, or residues 55-960 of SEQ ID NO:20.

17. The non-native glucosyltransferase of claim 9, comprising an amino acid sequence that is at least about 93% identical to SEQ ID NO:4, SEQ ID NO:65, SEQ ID NO:30, SEQ ID NO:28, or SEQ ID NO:20.

18. The non-native glucosyltransferase of claim 17, comprising an amino acid sequence that is at least about 95% identical to SEQ ID NO:4, SEQ ID NO:65, SEQ ID NO:30, SEQ ID NO:28, or SEQ ID NO:20.

19. The non-native glucosyltransferase of claim 18, comprising an amino acid sequence that is at least about 96% identical to SEQ ID NO:4, SEQ ID NO:65, SEQ ID NO:30, SEQ ID NO:28, or SEQ ID NO:20.

20. The non-native glucosyltransferase of claim 19, comprising an amino acid sequence that is at least about 97% identical to SEQ ID NO:4, SEQ ID NO:65, SEQ ID NO:30, SEQ ID NO:28, or SEQ ID NO:20.

\* \* \* \* \*

UNITED STATES PATENT AND TRADEMARK OFFICE
CERTIFICATE OF CORRECTION

PATENT NO. : 10,301,604 B2
APPLICATION NO. : 15/702893
DATED : May 28, 2019
INVENTOR(S) : Yougen Li et al.

It is certified that error appears in the above-identified patent and that said Letters Patent is hereby corrected as shown below:

In the Specification

In Column 40, Line 13 (in Table 5):
Please replace "0847$^a$" in the first column of the table with --0874$^a$--.

Signed and Sealed this
Second Day of July, 2019

Andrei Iancu
*Director of the United States Patent and Trademark Office*